United States Patent 11,098,302 (IDENTIFICATION OF POLYNUCLEOTIDES ASSOCIATED WITH A SAMPLE) - sequence listing, part 88

SEQ ID NO: 305221 - DNA, 705 bp, Homo sapiens
  misc_feature: GZ8MTXP02G8WN8.10.71.G05.1.454.CMB.2.raw
  modified_base (429)..(429): a, c, t, g, unknown or other
  misc_feature (429)..(429): n is a, c, g, or t
tcagcatagtagtgcacgaccggtgctcgatttagtgtcgtcgcaagagagagggggaggagcccagcactagaagtcggcggtgcctccattcggtgatcagcactgaacacagaggactcaccatggagtttgggctgagcttgggttttcctcgttgctcttttaagagatgtccagtgtcagatgcagagtggtggagtcgtgggggaggcgtcgggtccggccgtcgggggtccctgagtactctccgtgttctgcgtctggtattcattcgtttaagaatcgtggtacattcgtccgtgggtcccgtaccgtacggtttcccgacggtcccggacggggtccttaggggaacgttggggtcggacgtaaggtaacttaacgtaacaaagttagtagaatacgaaacgttaaagtaaaaacttntaaacgttaagtacgggtaacgtacccgttacttaccgggaaacgggtacccgtattacccaaccgtaactcccgtaacccaagtaaccgtaactaaacgttacccgaaaagtaacctaaggttcggtaacgttactacgtaggaactaaaacgtcgaaccacggtcctaggacggaaccgtacggaacggtacgtacgggtttctttaaacgttacgaggttagggaaactaacgttacgaagtcggactacgtacgtacgtttggtacttccgg

SEQ ID NO: 305222 - DNA, 675 bp, Homo sapiens
  misc_feature: GZ8MTXP02HDW3U.10.71.G05.1.454.CMB.2.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgttcgctacttcggttagggtgtatcaanataatccggcaggctccagctcctnatctttgatgtcctttacaacgccggcccctggccgtcccgaggctaggtcaggtcggcaggtggggtctggggacagtaccttcncctctacacctagtaccagccaacgtcctagacgtcctagtagttattttgacctttaagttttattactagtacgtacggtacgtaggtccgttacgcccgttaaccgggtttcgggaccggggtacgggttccgtacccgttacgggtttaccggggaccgggggtaacggtaaaacccgtaaaaggttacgggtaaaccggtaaccgtaaaaacggtaccgttagggtacgggtccctaacggtaacccaaaccgttacgttccgttaccggtttaccgttaccgtacctttcccccg

SEQ ID NO: 305223 - DNA, 758 bp, Homo sapiens
  misc_feature: GZ8MTXP02HVFB5.10.71.G05.1.454.CMB.2.raw
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttcngcgtctggattcatctttagtaaatctggcattgtcccgtggggtcccnccgtaggtcccaggcccacggggctgggaacgtggggtggcccaggacttagtaacgaattagtagatagaaacaaagttaaaaattataactaagtagggactaccttacccgttacgaaacggggtcccgaatttacccaaccgtattaccctacccaagaacgtaaactaaactttacccaaaagtaaaccgtaagttacggggttagttaacgttacccgttaggtaaacctaaaaagttacccgggaaaccctaaaacgggtacccccgtttaaagggaaaacgggtaccggggtaaccccccgggaaagggggtaaaacccggttaacccggggggtttaacgttttttttaacggttaaaaccggtttaagggttaaggggggtaaaactttaaaacggttaccccggtttaaaggggtacggggttacccttaaaccg

SEQ ID NO: 305224 - DNA, 748 bp, Homo sapiens
  misc_feature: GZ8MTXP02I64U8.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggacgtcggtgggggaggcggtcgggtccgggccggttcggggggtccctggacgtaccttccgtccttgttcgtgcgttcgtggtacttcattctttaagtaatcgtggactagtcgtccgtgggtcccgccgtacggttccgaacggtcccgacggggtacgtcgggtaagtggggtcgaccaaggtataagtaacaatagtagtaatacgaaactaaaaggttaaaacttattaacgtaaggtacggtaacgtaccccgttaaccgttacgggaaacggggtaccctaacgtttacccaaccctaactcccgtacccgaaagtaaccgtaaactaaaccgttaacaaacgacgtagttacgggtattacgttctacgtaacaaactcgaaccgttacgacgtaaacgaggacggtaaaccccggaaggtacggttaaccgggtttagttttaaccgtacggttaagggtacgggtaaaacgtaaccgttacgtaagggtaccgtacgttaaacctccggttaaccgttggtttaacggtttacgg

SEQ ID NO: 305225 - DNA, 606 bp, Homo sapiens
  misc_feature: GZ8MTXP02FHZ3G.10.71.G05.1.454.CMB.2.raw
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggccgtgggggtccctgagctctcctgttctgcgtctggattctattctttagtaaatctggctatcgtccgtggggtcccgccgtacggttccacgggccgacggggcttgggaagtggggtgccagatatacaatangntagactaaagtaaaatatactatggatactcccttacgaaggccgtattcacctatcctaccaagaacgtaacaaacttaccaaaacggtaacattaggggttataacgtcttaacgactaaaatcggaacccagacccgtaggacgacgacccggaaggtacgtaacggggtttagttttaacttaacgtgggtagggtaagtaaaacgttccgtaacggtggaccctaacg

SEQ ID NO: 305226 - DNA, 670 bp, Homo sapiens
  misc_feature: GZ8MTXP02GNLK4.10.71.G05.1.454.CMB.2.raw
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (501)..(501): a, c, t, g, unknown or other
  misc_feature (501)..(501): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcgttgggttttcctcgttgcttcttttaagagatgtccagtgtcagatgcagatggtggagtcgtgggggagcgtggtccggcgtgggggtcctgagactctcctgttctgcgtctggtattcgattactttaagaaatctggactagtcgtccgtcgggtccncgtacggttccaggcccacgggctaggaagtgggtgacagatagacatangatagaactaaagttaaatntacgtaagtaggaactaccttacgttaacgaaacgggtaccctaacttacccgaacctacttaccgtaccgaaagaccgtaaactaaacgttcccaaaagactagttaggattaactccgtaanacgtaaaagtaccgacgaacgtccgtagaacggacccggagaaacggggtaaccgtttacggggtttatttttaaaccgacggttaagggtacggggtaaaactaaccgttaccggttaaaggacggtacctaaacggtccgtaaccgtttaggtttatttaaccgggg

SEQ ID NO: 305227 - DNA, 717 bp, Homo sapiens
  misc_feature: GZ8MTXP02FOSDU.10.71.G05.1.454.CMB.2.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (592)..(592): a, c, t, g, unknown or other
  misc_feature (592)..(592): n is a, c, g, or t
  modified_base (605)..(605): a, c, t, g, unknown or other
  misc_feature (605)..(605): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgacagtagtggtggagtcgtgggggaggcggtggtccggcgtggggtccngacgctctcctgttcngtcgtctggacttcattactttaaggtaatcgtggctagtcgtccgttccggggtcccgacgtacggttcccgagggcccgacggggtccgtagggaagtcggggtacggccaaggtataactaacgtaaattagtaagtatacggaaataaaaggttaaaaacttaacgttaaacttaggtagggtaacgttaccgtttaaccccgtttacggaaacggggtaccctaactttacccgaaaaccccctgttaccctaaccgaaaggaactaaaacgtaacttaaacccgaaagtaaactaggttaccggttacgtaattcgganaaaccgttaaaanacccgaacgtacgtacgtacggacggacggaccggtaaaggtaccggttacggtttagttaacgttacggtaaggttaacggtaacgtacgttaccgtagtaccgtactacg

SEQ ID NO: 305228 - DNA, 732 bp, Homo sapiens
  misc_feature: GZ8MTXP02IM5SM.10.71.G05.1.454.CMB.2.raw
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcgtgggtccgccgtgggggtccctgagactctctagttcngcgtctggattcatctttaagtaaatctggacagttcgtcctggggtacccncgtaaggttccaagggtcccaaggggcctagggaaacgtggggtgacccaaggtatataacgtaatatgagtgaaactaaagtaaaatataacgtaaagttaggaagtacccttaccgttaacgaacggggtaccctaatttacccaacccgtaattacccctaccgtaaaaggaaactaaaccttaaaactttaaccccgaaaaagggtaaacctaacgggtttaggggtaactttaaacggaccttaacgggaaaaccaattaacgtaaccgaacgtaacccgttacggaaaggacggaccggaacgggtaaaccgggtaaccggggtttaacggtttaaacgtttaacgttaacgggttaaacgggtaaaggtaaaacgtaacccgttaacggtaacggttaacggtaaaccg

SEQ ID NO: 305229 - DNA, 641 bp, Homo sapiens
  misc_feature: GZ8MTXP02FJF4T.10.71.G05.1.454.CMB.2.raw
  modified_base (264)..(264): a, c, t, g, unknown or other
  misc_feature (264)..(264): n is a, c, g, or t
  modified_base (551)..(551): a, c, t, g, unknown or other
  misc_feature (551)..(551): n is a, c, g, or t
tcagcatagtagtgcacgaccggtgctcgatttagtgtcgtcgcaagagagaggggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtggggggaggcgtggtccggccgtgggggtccctgagactctcctgtcngcgtctggattcattctttagtaaatcgtggcatcgtccgtgggtccgccgtacggttccacgggccgacggggctagggagtgggtggccagatataacaatagtgagtagaactaaagtaaaatataactaagtaggaaacgtaccttaccgttacgaaacggggcccgtaacttaccaacccgtatacccgttaccaaacggtacgtaaaaccaaacgtttacccaaaagtacctaagttagggtagttaactcgtagacctaaagtacgacctagaccgtagngacggcggtaaacggacgttaaccggggttatttaccgttagtcgggtaagggtaaacgtaaaacgtcccggtaaaggtcgaccgtaacg

SEQ ID NO: 305230 - DNA, 584 bp, Homo sapiens
  misc_feature: GZ8MTXP02JKQFL.10.71.G05.1.454.CMB.2.raw
  modified_base (203)..(203): a, c, t, g, unknown or other
  misc_feature (203)..(203): n is a, c, g, or t
  modified_base (377)..(377): a, c, t, g, unknown or other
  misc_feature (377)..(377): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcggttagggtggtatcaacataaatccggcaggctccaggctcctcatctttgatcgtctttcaacgacgggcccctggcctcccaggcaggttcagtggcaggtcgggtctggggacagtacttcacgttcncacctatcagtcagccctagacgcctagaatactttgcctagtttacttactagtctagccagtccgtagcctacgttcgggacggtacggtcgacccgtacgtttccgggcggggtaaggaacccgtaaaagttacggaacgggtaccaaaacggtaacgtaggtaccgtgtacggaacacgaactctcgtacttctacgtttccc

SEQ ID NO: 305231 - DNA, 780 bp, Homo sapiens
  misc_feature: GZ8MTXP02JLIMQ.10.71.G05.1.454.CMB.2.raw
  modified_base (196)..(196): a, c, t, g, unknown or other
  misc_feature (196)..(196): n is a, c, g, or t
  modified_base (314)..(314): a, c, t, g, unknown or other
  misc_feature (314)..(314): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcttgggttttcctcgttgcttacttttaagagtatgtccagtntcagatgcagatggtggagtcggtgggggagcgtggtccggcggtggggtcctgagctctcctgtctgcgtctgattcattatttagtaatcgtgtctagtcggtccgtcgggtcccncggtacgggttcccacgggcccgaggggtctaggggtagtgggggtgaccgtaggtattaacgtaataagttagtggtagtagtaaaacgttaaaggttaaaaattagttaaccgtaagtacgggtaaaccgttacccgtttaaccccggtttacggaaaacccgggggtccctaacgtttacccaaccctaacgttaccccgtaccgaaaggaaaccttaaaccgtaaacgttaaccccgaaaagtaccgtaaggttaggttaacgtaacttcccgtaaaggtaaacctaacgttaccgtaaacccgtacggggacccttaaagggaacgggaccgggtaacccgggtaaaacgggtacccggtttaaggggttttacgttttaacggttaccggggttaacggtaagggggttaaaacttaaaccggggttcccgtaaaaggtttccggttactttaaacccgg

SEQ ID NO: 305232 - DNA, 562 bp, Homo sapiens
  misc_feature: GZ8MTXP02IWX8M.10.71.G05.1.454.CMB.2.raw
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggtcctgagctctctgttctgcgtctggattcattctttagtaatctggcattgtcctgggtcccnctaggttccagggccacgggctggaatggggtgcagactataacaattangatgaactaagtaaaatntaactagtgaacgtactcctagaagggaccgtatcaccatctaccagacacaacttccaaagtacattaggtagtactctagactaaaatcgaacacgcctaggacgacgtaccggaacggtacgttacgggttacgttttagttacgtaaggtagggaacgttaaacgtaccgttaggtacggacttacg

SEQ ID NO: 305233 - DNA, 793 bp, Homo sapiens
  misc_feature: GZ8MTXP02JYWXA.10.71.G05.1.454.CMB.2.raw
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtcttgtctccgaggggaagagccacctctcctgcagggccagtcagagtgttcgcacgttcgtagggtgtatcaacataaatcgcagcnccagctcncatcttgatgactttcaaacgtacggccccgtggtccgtccccgaaggtccgacggtttcaagggtcggggccaaggggttcggggtaccgttagggggaactacggtaaccgtttccgaccttcccgttaccaaaccctaacgttaccgaacgtaccgaacggtaccccgttaaaggaaccgggttcccccttaaggtaaaaggttaaacgtttttttcgggacccttaaaggttttttaaactttaacccggttagtttaccctaaaggggtacaaacgggtccggtttaccgtaccccgttaaaccggtttttccggggaccggggtaaacggggttcggtaccccgtaacgggttttccggggacccggggtaaaacggggaaaacccctaaaaaaggtaaggttaaaagggacccgaaaaaaacggtaaaccgttaggtaccggggaaccgttacggaaccgtaacccctaagtaccgtttcggtacctttacctaacgtttcccccg

SEQ ID NO: 305234 - DNA, 608 bp, Homo sapiens
  misc_feature: GZ8MTXP02FH39Y.10.71.G05.1.454.CMB.2.raw
  modified_base (206)..(206): a, c, t, g, unknown or other
  misc_feature (206)..(206): n is a, c, g, or t
  modified_base (403)..(403): a, c, t, g, unknown or other
  misc_feature (403)..(403): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagcccacgctgtcttttgctccgaaggggaaanagcccaccctctcctgcagggccagtcagagtgttcgctacttcggttaggggtgtatacaacataaactcccggccaggcctcccgaggcctcctcatctttgatgtctttacaacgtacgggcccctgggccgtcccgaggccgtagggttccaggtcggcgagggttggggtcgtggggacagaccttcactcncacatcagcacgcctagacgcctagaacgtattttcgacttagttttaacttacgtgtacagtcaggtcgtgcctacggtttcggcggtaggtcgaccgtacgttcggacggggtaacggaaaccaaaagtacggaggtaacaaaacggtaacgtagtacggctacggaacgtacctagtcgttacgtccttacgtacttccccg

SEQ ID NO: 305235 - DNA, 785 bp, Homo sapiens
  misc_feature: GZ8MTXP02HEN5X.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtgagtcgtgggggagcgtggtccggcgtgggggtcctgagctctctgtctgcgtctggattcattcttaagtaatcgtggctatgtccgtgggtcccgccgtacggttcccagggcccgagggtccgtagggaacgttggggtacggccaaggtaattaactaacgaaattagtggtaaactaggaactaaaagttaaaactacttaacttaagagggtactaacccgttaccgttacggaaacggggtcccgtaatttacccaacctacgtacccttaccgaaaaggacgtaaaccttaaaacgttaaccgaaaaacggaaacctaagttacgggggtttaagttaaactttaccgttaacggaacctaaaaagtttaccggaaacccgaacggtcccggttaaaggaaccgggaaccggttaacccgggaacgggtaaaacccggttaaccgggggtttagtttttaaaacgtaccggttagggttaaaccgggggtaaaattaaaaccccgggttcgttaaaaggggtccgggtacttaaaaccgtccggtttaacccggttacgggtttaaatttccggggg

SEQ ID NO: 305236 - DNA, 759 bp, Homo sapiens
  misc_feature: GZ8MTXP02FZV04.10.71.G05.1.454.CMB.2.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaancgcccaccctctcctgcagggccagtcagagtgttcgctacgttcggttaggggtgtatacaacataaagtccggccaggctcccaggcctcctcattctttgatgctttacaacgcgggcccctggccgtcccgaggctagggttcaggtcggctaggtcgggtcgtaggggacagtaccttcacctccgtaccaaccactacgaacgtccgaacgtaccctaaaggacgtacccgtaagggtaaagttatttttacgacgtttaaaggtttttaactttacgttacgggttacaaacgggtactaacgggtccggttacgtaccccgttaccgggttttaccgggggaccggggttaacggggttaccggtaccccggtttaacccggtttacgggggaccgggggtaaaacgggggtaaaaccctaaaaacggtaacgggtaaacggggtaaaccgtaaaaaccggtacggtttacggggtacgggtaccgtacggtaaccctaaccgtaacttccgttaccgtttacgtttaccgtacctttacccccgg

SEQ ID NO: 305237 - DNA, 678 bp, Homo sapiens
  misc_feature: GZ8MTXP02JRYHS.10.71.G05.1.454.CMB.2.raw
  modified_base (401)..(401): a, c, t, g, unknown or other
  misc_feature (401)..(401): n is a, c, g, or t
  modified_base (637)..(637): a, c, t, g, unknown or other
  misc_feature (637)..(637): n is a, c, g, or t
tcagcatagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggcgtggggtccctgagactctcctgttctgcgtctggtattcattctttaagtaatcgtggctagttcggtccgtcgggtcccgccgtacggttcccgagggtacccgaacggggtcttaggggtaacggtcgggggtgacccgtaaggtactaacgtaaactaattagnggtatacgaaacgtaaaagttaaaataagtaacgttagtaacgggtaactaccgtttacccgtacgaaaccggggtaccctaattacccgaaccctacgtccctacgaaacgaagaaacctaattaacccgaagtaatacgttgggttaactactcgtagaacgtaaactccgaccacggtccagggtacgacggtaccggaaggtaaccggtacgggtttatttaacgtttacgngggtaacggtaaacgaacgttaccgtaggacgtactaaccg

SEQ ID NO: 305238 - DNA, 866 bp, Homo sapiens
  misc_feature: GZ8MTXP02IAG1T.10.71.G05.1.454.CMB.2.raw
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgctacttttaagagatgtccagtgtcagatgcagagtggtggagtcggtgggggaggcggtcgggtccggccggtcggggggtccctgagtactctccgtgttctgtcgtctggtattctattctttaagtaatctggactagttcgtcccggtggggtccccgtccgtacggttcccgacgggccccgacggggtcgtaggggtaaggttggggtcggactaggtaataataactaagttagtagtaatacggtaaactaaaaggttaaaaattactaacgttaaggtaacgggtaaccgttaacccgttacccgtttaaacgggaaaccggggtccccgtaaacttacccgtaaccctaacgttacccctaaccggaaaacggtaaaccgttaaaccttaaaaccgttaaaccccgaaaagggaaaaccctttagggtttacggggttttaaacgttaactttaccggttaacggaaaaccgtaaaacgttacccgggaaaaccctacggtaccccggttaaagggaacgggaaccggtacccgggggtaaaacggggtaccgggtttaaaccgggggttttagtttttaaacgtttaccgggtaaggggtttaacggggaaaaccgttaaacgttcccggttaagggtcggtaacccgttaacgttacccgtaaaccggtttgggtttaaacggtttccgggg

SEQ ID NO: 305239 - DNA, 786 bp, Homo sapiens
  misc_feature: GZ8MTXP02H90DL.10.71.G05.1.454.CMB.2.raw
  modified_base (316)..(316): a, c, t, g, unknown or other
  misc_feature (316)..(316): n is a, c, g, or t
tcagcatagtagtgcacgaccggtgctcgatttagtgtcgtcgcaagagagagggggtctgggagaggagccccagcactagaagtcggcggtgcctccattcggtgatcagcactgaacacagaggactcaccatggagtttgggctgagcttgggtttttcctcgttgcttcttttaagagatgtccagtgtcagatgcagatggtggagtcgtgggggagcggtgggtccggccgtgggggtccctggagactctcctgtctgcgtctggatcattctttaagtaatctaggctatcgttccgtgggtccccnccgtaaggtttccccaagggtccccgaacgggggtccttaggggaaagtgggggtaggaccgtaaggtaactaattaaaccaaattaagttgaagtacgtaacctaaaagtttaaaaaatagttaaaccttaaagttaggggaaacttaaccttacccccgtttaacgaaacgggggtacccgttaactttacccgaaccctaaacttcccttaaccccgaaggaaacgtaaacctaaacgtttaaccccaaaagaaaccctaggtttaacgggttataagttaccttagaaacctaaaagttcggaaaccctaaaggcccgttaagggaaacggaacggttacccgggaaacggggaacccgttacgggggtttaacgtttttaagtttaaaccggtttggggttaaccggggaaaggttaaaaccttaccggtaacggttccggaactacggtttaacctaacccggg

SEQ ID NO: 305240 - DNA, 800 bp, Homo sapiens
  misc_feature: GZ8MTXP02I81MP.10.71.G05.1.454.CMB.2.raw
  modified_base (319)..(319): a, c, t, g, unknown or other
  misc_feature (319)..(319): n is a, c, g, or t
tcagcatagtagtgcacgaccggtgctcgatttagtgtcgtcgcaagagagaggggggaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcggtgggggaggcggtcgggtccgggccggtcggggggtccctggacgtactctccttgttctgcgtctggtattcattactttagtaaatctggctagtcgtccgtggtcccncgtacggttccaggcccgacgggtcgtagggaacgttggggtacggactaaggtaactaacgtaactaaagttataggtaataacgggaaactaaaaggttaaaaattacgttaaactaaaggtacggggtaaacgttaacccgttacccgtttaaacgggaaacgggggtacccccgtaatttacccgaaccctattcccctaaccgaaaggaacctaaactaaacttaaacccgaaaaggtaacctaggttacgggtaacttacgttactaacggaacctaaaagtcccgaaaacccgcgtacccgtagggaaacgaccgggtaacccgggtaaaggtaccggttaaacgggggtttttcttaaaccgtttaaacggggtacgggtaacggggtaaaacgttaaaacccgttccggtaaagggtttcggaaaccttacggttaacccgtaaccgggtttacggtttacgtttaccgggg

SEQ ID NO: 305241 - DNA, 693 bp, Homo sapiens
  misc_feature: GZ8MTXP02GNEYT.10.71.G05.1.454.CMB.2.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagcatagtagtgcacgaccggtgctcgatttagtgtcgtcgcaagagagagggggaggaactgctcagttaggacccagagggaaccatggaagcccccagctcagcttctcttcctcctgctactctggctcccagacaccaccggagaaattgtgttgacacagtcctccagccacgctgtctttgctccgaggggaaancgcccacctctcctgcagggccaagtcagtagtgttcgctacgttcggttaggggtgtaatcaacataaactccggcaggctccgaggctccnctattctttgatgtctttacaaccgtaccggcccctaggccgtacccgaggtccgtaggttacaggtcggtcgtacgggttcggggtcgtaggggaccacggtaacctttcccaccttccctacgaaccctaactcaacggacctacggtacccgtaggacgtaccgtaaggtaaagttattttacggacgtttaagtttacttacgtagtacaaggcctaggtcccgtagtacccccgttaggtttccggggacggttacggttcgtaacccgttacgggtttacggggaacgggaacggggtaaaacctaaaaaggtacggaaacggttaaacgaaaaccgtagttcggtaggactacgaacctacgtacttcgtacgtctttacgctttcccg

SEQ ID NO: 305242 - DNA, 635 bp, Homo sapiens
  misc_feature: GZ8MTXP02I41GA.10.71.G05.1.454.CMB.2.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcggtgggggaggcggtgggtccggccgtgggggtcctgacgctctctgttctgcgtctggattctattcttagtaatcgtggcatcgtccgtcgggtcccgccgtaggttcccgacggtcccgacggggtcgtaggggtacgtggggtcgaccgagtattaacgtaactaagtagtagagtagaaactaaagttaaaatattaacgtagtaggaacgtcttacccgtacgaacggggtacctacttacacctagtacctaccgagaacgtaactaacttaccaaagtaacctaggttacgggttatactacgtagactaaaagtccgaacgacgtcgaggacgacggaccggtaaggaccgtttagggttaacttttacgtacggtcggtagggaactaacgttcgtacggcggtactaacg

SEQ ID NO: 305243 - DNA, 308 bp, Homo sapiens
  misc_feature: GZ8MTXP01D6LV3.10.5.A05.1.454.CMB.2.raw
  modified_base (307)..(308): a, c, t, g, unknown or other
  misc_feature (307)..(308): n is a, c, g, or t
tcagcatagtagtgcacgaccggtgctcgatttagatagatagacagggggaagaccgatgggcccttggtgaaggcctcggacaccgccatgtattactgtacgagacttgaacggggattctattatggcgcgatctggggccagggaaccctggtcaccgcctcctcagcctccaccaagggcccatcggtcttccccctggcaccctcctccaagagcacctctgggggcacagcggccctgggctgcctggtcaaggactacttcccactactatgctgagcgggctggcaaggcgcatagnn

SEQ ID NO: 305244 - DNA, 564 bp, Homo sapiens
  misc_feature: GZ8MTXP01C68P4.10.5.A05.1.454.CMB.2.raw
  modified_base (343)..(343): a, c, t, g, unknown or other
  misc_feature (343)..(343): n is a, c, g, or t
  modified_base (501)..(501): a, c, t, g, unknown or other
  misc_feature (501)..(501): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcggagcagaggtagaaaagccgggatctgtgaagatctcttgcacgggttcaggagacagattagcagcgactggctcggctggtgcgccagatcggcccggggaagccgtggagtggagtggggatcgatcaaattcgttggtagcttactagaaaaccngaactacccgaaccccgttccttccgaaacgggcccgggtacaccatctacgacgccgacacggtccatcagtactacctacgtggagtgattagcctggggaacgccgtacggacaccgccagtgtactctgtacgagtacgttaaggaacgggttntttcgttagttagtggcgcgagtcggtcgggccgtaacgggacccttcggtccgcccgtcccg

SEQ ID NO: 305245 - DNA, 619 bp, Homo sapiens
  misc_feature: GZ8MTXP01CDKQA.10.5.A05.1.454.CMB.2.raw
  modified_base (315)..(315): a, c, t, g, unknown or other
  misc_feature (315)..(315): n is a, c, g, or t
  modified_base (409)..(410): a, c, t, g, unknown or other
  misc_feature (409)..(410): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctcgtgggcgaggacgggccaccatcagctgcaggtccagccagagtgttctcttacaacaagaaacaataaggaattgttagcttaggaccagacaagaaaccaggacagtcctacctaagctgctctatttacgngggcagtccggaacccgggtaagtcccggggtcctgaccgattcgaggtggaccagggcgggtctaggggacagaattcactctcacatcaacnncctgctagctagaagtagtgtaggtacttagttttactttccgtagttaccaaagttagttactttccttttcgttccgtccgggttacggtacccggtttcgggaaccccgaaagggggtaaccccttaaaggggttaccgggaaaccttacccggaaaacggttaccgttgggtcggcttacgaccttaaccctaagttcgtttccg

SEQ ID NO: 305246 - DNA, 552 bp, Homo sapiens
  misc_feature: GZ8MTXP01DXJ93.10.5.A05.1.454.CMB.2.raw
  modified_base (339)..(339): a, c, t, g, unknown or other
  misc_feature (339)..(339): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagatttagcagcgactggctcggctggttgcgccagatggccccggggaaggcctgggagtggatgggggatcatcaatctggagctctagaaacngactaccaaccccgtcttccgaaggccgggtacaccgatctcgacgccgacaggtccatcagtactactacgtggagtgattagcctagggaacggcctacggacaccgccatgtaattactgtacgtagcttaaggaacggggttattcgttagttaagtggcgcgagtcggtgggggccctaacggggacccttgggtccaacccggtccc

SEQ ID NO: 305247 - DNA, 536 bp, Homo sapiens
  misc_feature: GZ8MTXP01CAL96.10.5.A05.1.454.CMB.2.raw
  modified_base (302)..(302): a, c, t, g, unknown or other
  misc_feature (302)..(302): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (528)..(528): a, c, t, g, unknown or other
  misc_feature (528)..(528): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaacagaaacaataaggaatgttagcttggtaccagcagaaaccaggacagtctctaagctgctcatttacngggcagtccgacccgggatcccggggtcctgacccgtattcgagtggacaggcgggtctggggacagaacttcactctcaccatcacngcctgcagctgaagntgtggcgtagtttattctgtacaactgttacttctttcttcgtccgttgggtccgtttcgggaccttaaggggtacccaagggtacgaacttacgaaacgttacgtggtcgctcgacaccgtnttcgttcg

SEQ ID NO: 305248 - DNA, 579 bp, Homo sapiens
  misc_feature: GZ8MTXP01DT4Y4.10.5.A05.1.454.CMB.2.raw
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggatctgtagaagatctcttgcgacgggttcaggagacagtatttagcagcgactggctcggctggtgggcgccagacgtcggaccccggggaaggccgtgggagtaggagtgggggatcatcaattcttgganctctagaaacngactaccaaccccgtcttccgaggcccggtcaccatctcacgccgacgacggtccatcagtacctactacgtggagtgatacgcctagggaacgcctacggacaccgcctagtagttaattctgtacgagtacgttaaggaacgggttatttcgttagttagtcggcgcgttacgtcggtacgggaaccgaacggggacccgttggtaacccgaacccggtccccg

SEQ ID NO: 305249 - DNA, 553 bp, Homo sapiens
  misc_feature: GZ8MTXP01CTP0E.10.5.A05.1.454.CMB.2.raw
  modified_base (312)..(312): a, c, t, g, unknown or other
  misc_feature (312)..(312): n is a, c, g, or t
  modified_base (424)..(424): a, c, t, g, unknown or other
  misc_feature (424)..(424): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagagggccaccatcagctgcaggtccagccagagtgttctcttacaacagaaaacaataaaggaatgttagcttggtaccagacaagaaaccaggacagtcctctaagctgcttacatttacngggcagtccgacccgggaatccggggtccctagaccgattcgagtggacaggcgggtctggggaacagaacttcactctacaaccatacaacacgcctgcaaggctagaagntggtggcttaagtttatttcgtgttacaacgtagttattctttctctcgtggtacgttcggacgaaggtaccgaaggtacggaacttaacgaaacgttaacgtgtacggctcgacaccgtaattccgtg

SEQ ID NO: 305250 - DNA, 599 bp, Homo sapiens
  misc_feature: GZ8MTXP01CYXUV.10.5.A05.1.454.CMB.2.raw
  modified_base (324)..(324): a, c, t, g, unknown or other
  misc_feature (324)..(324): n is a, c, g, or t
  modified_base (503)..(503): a, c, t, g, unknown or other
  misc_feature (503)..(503): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagacgggccaccatcagctgcaggtccagccagagtgttcctcttacaaacaagaaaactaagtaaaggtaattgttagcttaggtaaccagacaagaaaccaggacagtcctactaagctgctactatttacgngggacacgtccggaaccccgggtaacgtcccgggggtaccctacggacccgtagttcgaggtcggacgaggtcgggtctaggggactaggtaacttcactcctacaacctatacaaacgcgcccgtgacaggtctaggaagtgtggtcgtacgttagttttacttcgtgtactaacgtnttactttctttctccgtccggtaggtccgttcggacgaacgggtaccgagggtacgacttacgaaacgacgttgcgtctagccttactcttcgttc

SEQ ID NO: 305251 - DNA, 602 bp, Homo sapiens
  misc_feature: GZ8MTXP01CDDVV.10.5.A05.1.454.CMB.2.raw
  modified_base (314)..(314): a, c, t, g, unknown or other
  misc_feature (314)..(314): n is a, c, g, or t
  modified_base (479)..(479): a, c, t, g, unknown or other
  misc_feature (479)..(479): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagaggccaccatcagctgcaggtccagccagagtgttctcttacaacagaaacaagtaaaggaatgttagcttggtaccagacaagaaacccaggacagtctacctaagctgctactatttacgngggcacgtccgacccgggaagtccccgggtcctcgaccgtattcgaggtcggacaggtcggggtctaggggaacagtaacttcgactaccgtccaacctatacccaaacgacgcccttgaccacgggtactaggaagtagttgtagggtcttaaggttttattcngtacaacgtgttactttcctttccttcgtccggtggtaccgttccgggaccgttaagggaccttaagggtacgtaacttaacgaacgttacgttggtacggctcgccttaccgtgttcgttcg

SEQ ID NO: 305252 - DNA, 543 bp, Homo sapiens
  misc_feature: GZ8MTXP01ACN6P.10.5.A05.1.454.CMB.2.raw
  modified_base (405)..(405): a, c, t, g, unknown or other
  misc_feature (405)..(405): n is a, c, g, or t
tcagcatagtagtgcacgaccggtgctcgatttagatagatagacaggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaacagaaacaataaaggaatgttagcttggtaccagcaagaaaccaggacagtctcctaagctgctctatttactgggcatccgaccgggaatccggggtccctgaccgatcagtgacagcggtctgggacagatcactctcacatcaacagcctgcgagctagaagatgtcggntagtttattctagtactaactagtacttctttcttcgtccgtggtaccgttcgggtaccaaaggggtacccaaaggtcgggaaacttacgaaaaccgaaccgtggtacgggcttacggacttacccgtaattcgttcg

SEQ ID NO: 305253 - DNA, 589 bp, Homo sapiens
  misc_feature: GZ8MTXP01DTLCS.10.5.A05.1.454.CMB.2.raw
  modified_base (242)..(242): a, c, t, g, unknown or other
  misc_feature (242)..(242): n is a, c, g, or t
  modified_base (338)..(338): a, c, t, g, unknown or other
  misc_feature (338)..(338): n is a, c, g, or t
  modified_base (521)..(521): a, c, t, g, unknown or other
  misc_feature (521)..(521): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggatctgtgaagatctcttgcacgggttcagganacagtattagcagcgactggctcggctggttgcgccagatcggaccccggggaaggccgtggagtggagtgggggatcgatctaattcttaggtanctcctagaaaaccagactaacccaacccccgttccttcccgaaacgggtcccgggtaccaaccgtatccgtacacgcccgaacacggtccatcaagttactacctacgttggagtgtacttagcgtagggaagcctcggacaccgcctatgtacttactgtacgagtcgttaagaacgggttnttcttagttagtggcgttcgacgttcgtcggggaaccaaggggaccccttgggtcccaaccggtcccc

SEQ ID NO: 305254 - DNA, 552 bp, Homo sapiens
  misc_feature: GZ8MTXP01DJCLK.10.5.A05.1.454.CMB.2.raw
  modified_base (304)..(304): a, c, t, g, unknown or other
  misc_feature (304)..(304): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagaggccaccatcagctgcaggtccagccagagtgttctcttcaacagaaacaataaggaatgttagcttggtaccagacaagaaaccaggacagtctcctaagctgctcatttacngggcatcgacccgggaatccggggtcctgaccgtattcgagtggacaggcgggtctggggacaagattcactctcacatcaacagcctgcaggctagaagatggtggcttagtttttaactttctcgtacaaactgttacttctttcttcgttccggtgggtaccggttcggaccgttaaaggggacccaagggttacggaacttacgaaaacggttacgtggtacggctcgccttaccaagttctcg

SEQ ID NO: 305255 - DNA, 650 bp, Homo sapiens
  misc_feature: GZ8MTXP01EVR8E.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggagtctgtgaagatctcttgctacgggttcaggagacagattagcagcgactggctcggctggtgcgccagacgtcggacccggggaagcctgggagtggagtggggatcatcgaattcgttggtacgctaccgtacgaaacagtactacccgtaaccccgttcccttaaccgaaacgggtcccgggtacaccctacttccacgacgcccgaacgacggtaccactcacgttaacctaccgttacgtaggacgtgtaacttacgcccgttagggaacggtcccgtacggaccaccgcctagttacgttaacttacgtacgtaacgtacgtaacgttaaggaaaccggggttatttacgttagttacgcgggttacgttcgttacgtcgggtacgggaacccgtaacgggtaaccccgttggttaacccgaacccgtccccg

SEQ ID NO: 305256 - DNA, 576 bp, Homo sapiens
  misc_feature: GZ8MTXP01DKZ7D.10.5.A05.1.454.CMB.2.raw
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccataactccctggctgtgtctcgtgggcgaggagggccaccatcagctgcaggtccagccagagtgttctcttacaacagaaacaataaggaatgttagcttaggtaccagacaagaaaccaggacagtctacctaagctgctntatttacgngggcagtccggacccgggaagtcccggggtcctcgaccgtattcgagtcggacagggcgggtctaggggaacagtaacttcactctacaccatacaacacgccctgccaggctaggaagagtgtggacttaggttttattcgtagtactaaagtgttatttcctttcttccgtccggtggtaccgttcggaaccgaaggggtaaccaagggtacgaacttacgaaacggttactggtacgctacgaccttacctaagttctcg

SEQ ID NO: 305257 - DNA, 581 bp, Homo sapiens
  misc_feature: GZ8MTXP01AUREH.10.5.A05.1.454.CMB.2.raw
  modified_base (321)..(321): a, c, t, g, unknown or other
  misc_feature (321)..(321): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagacgggccaccatcagctgcacggtccagccagagtgttctcttacaacaagaaacaataaggaatgtttagcttaggtacccagacaacgaaaccaggacagtcctacctaagctgctactactttacgngggactagtccggacccgggagtcccgggggtcctcggaccgtatcgagtcgacgaggcgggtntgggaacagtactcactcncacatcaacncncctagacaggctagaagtactagtcggattagtttattccgtgtaacaactgttacttctttccttcgtccggtggtaccgttcggaccgttaaagggaccttaacgggtacgtaacgttaccgaaacggttactggtaggcttacgacttacctaagttccctg

SEQ ID NO: 305258 - DNA, 591 bp, Homo sapiens
  misc_feature: GZ8MTXP01DQT96.10.5.A05.1.454.CMB.2.raw
  modified_base (509)..(509): a, c, t, g, unknown or other
  misc_feature (509)..(509): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggagtctgtagaagatctcttgcacgggttcaggagacagtattagcagcgactggctcggctggtgcgccagatggcccgggaagcctggagtggagtgggggatcgatcaattcgttaggtagctacgtacgaaacagtactacccgaacccccgttcttccgaacgggcccgggtacaacccatctacacgccgacaggtccatcagtactactacgtaggagtgattacgcgtaggaacggccgtacggaccaccgccagtcgtaattctgtacgacgtacgttaaggaacgggttntttacgttagtttagcgggcgttcgttagttccgtcgggggtcccgaacggggaccccgttgggtcccgaacccggtccccg

SEQ ID NO: 305259 - DNA, 619 bp, Homo sapiens
  misc_feature: GZ8MTXP01EAG4Q.10.5.A05.1.454.CMB.2.raw
  modified_base (319)..(319): a, c, t, g, unknown or other
  misc_feature (319)..(319): n is a, c, g, or t
  modified_base (427)..(427): a, c, t, g, unknown or other
  misc_feature (427)..(427): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgaggacgggccaccatcagctgcaggtccagccagagttgttctcttacaaacaagaaacaataaggaatgttagcttaggtaccagacaagaaaccaggacagtctacctaagctgctactattttacgngggacagtccggacccgggtaacgtcccgggggtccctacggaccgtattcgaggtcggaccagggtcggggtctaggggacagtaacttcacttcacacatacaacncgctgacgagcagaagtgtggtacgtacgtttaagttttacttcgtacgtaactaagttacgtttactttccttttcgttccgttccggtacggtaccggttaaccggaaccggttaaacgggtaaccgttaaagggtacgtaaaccttaacgaaacgttacgtgggtcgcgtacgaccttactcttcgtcg

SEQ ID NO: 305260 - DNA, 636 bp, Homo sapiens
  misc_feature: GZ8MTXP01CIMTS.10.5.A05.1.454.CMB.2.raw
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
  modified_base (534)..(534): a, c, t, g, unknown or other
  misc_feature (534)..(534): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaaggcccggggatctgtagaagatctcttgcgacgggttcaggagacagtattagcagcgactggctcggctggtgcgccagagtcggaccccggggaaggccgngggagtggagtgggggatcgatcgaattcgtgtagctacgtagaaacngactaccaaccccgtcttccgagggccggtacacctatcctcgacgcccgtacacggtaccatacgtacgtaacttacctacgttggagtgatacgtctaggggacgtccgtaccggacacccggtacctagtgttaaacgttacgtaggtaacgagtaaccgttaagggaaacgggttntttacgttaagtttacggtgggaccggttcggttaacgttccgggacgggggtcccgaaacgggggtaacccttcggggtaaccccgaacccgggttccccg

SEQ ID NO: 305261 - DNA, 587 bp, Homo sapiens
  misc_feature: GZ8MTXP01D7EZL.10.5.A05.1.454.CMB.2.raw
  modified_base (473)..(473): a, c, t, g, unknown or other
  misc_feature (473)..(473): n is a, c, g, or t
  modified_base (519)..(519): a, c, t, g, unknown or other
  misc_feature (519)..(519): n is a, c, g, or t
  modified_base (537)..(537): a, c, t, g, unknown or other
  misc_feature (537)..(537): n is a, c, g, or t
  modified_base (578)..(578): a, c, t, g, unknown or other
  misc_feature (578)..(578): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaaggcccggggagtctgtagaagatctcttgcgtacgggttcaggagacagtattagcagcgactggctcggcttggtcgcgcgagagtcggacccggggaagccgtggaggtggagtggggatcgatcaattcgttggagctctacgaaacagactacccaacccccgttcttccggaacgggtcccggtacacctagtctacgacgccgacgaggtccatcacgttactactacgtggagtgatacgcgtagggaacggccgtacggaccnccgcctagttagtattacgtgtaaccgagtcgtaaggaacgggttnttacgttagtagtggcgngttacgtcggtgggaaccgtacgggacccgttcggtaaccncccgtcccg

SEQ ID NO: 305262 - DNA, 554 bp, Homo sapiens
  misc_feature: GZ8MTXP01DI2M5.10.5.A05.1.454.CMB.2.raw
  modified_base (450)..(450): a, c, t, g, unknown or other
  misc_feature (450)..(450): n is a, c, g, or t
  modified_base (489)..(489): a, c, t, g, unknown or other
  misc_feature (489)..(489): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggtgcgccagatggcccggggaagcctggagtggatgggggatcatcaattcgttggtagctctagaaaccagactaccgaacccccgttccttcccgaaagggtcccgggtacaccgatctcacgccgacaggtccatcagtactactactggagtgatagcctggaacggcctcggacnccgccatgtattactgtacgagtacgttggaacgggttnttacgttagttagtgggcgcgagttcgtaggggccacggggaacccttgggtccaacccggtccc

SEQ ID NO: 305263 - DNA, 544 bp, Homo sapiens
  misc_feature: GZ8MTXP01CU2EH.10.5.A05.1.454.CMB.2.raw
  modified_base (485)..(485): a, c, t, g, unknown or other
  misc_feature (485)..(485): n is a, c, g, or t
  modified_base (535)..(535): a, c, t, g, unknown or other
  misc_feature (535)..(535): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagatttagcagcgactggctcggctggttgcgccagatggcccggggaaggcctgggagtggagtgggggatcgatcaattcgttggtagctcctagaaacagactaccaaccccgttccttccgaacgggcccgggtcaccgatctcacgccgacacggtcatcagtactactactggagtgatagctgggacggcctcgaccacgccatgtattactgtacgagtacgtggaacgggttnttcgttagttagtggcgcgagtcgtggggccgacgggacccttgggtccnccggtcccg

SEQ ID NO: 305264 - DNA, 690 bp, Homo sapiens
  misc_feature: GZ8MTXP01EPL14.10.5.A05.1.454.CMB.2.raw
  modified_base (602)..(602): a, c, t, g, unknown or other
  misc_feature (602)..(602): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccgggagtctgtgaagatctcttgcacgggttcaggagacagtattagcagcgactggctggctggttcgcgccaggacgtcggccccgggggaaggccgtgggaggtgggagtgggggatcgaatcgtaaattcgttaggtacgtctacctacgaaaaccgagtactacccgaacccccgttccttcccgaaacgggtccccgggtacaccctatctacgacgcccgaacgacggtccaataccgtaacgttaaccttaaccgttacgttagggaggttacggtatttaacgccgttacggggaaacgggtccccgttacgggaccctacccggcctagtttacgtaacgtttacgtaggtaaaccgtaggttaaccggttaagggtaaacggggttnttacgttagttaacggtggcgttcgttacgttcgggtcgggggaaccgacgggggtaacccgttcggtaacccgaaccccggtccccg

SEQ ID NO: 305265 - DNA, 719 bp, Homo sapiens
  misc_feature: GZ8MTXP01EZ3M3.10.5.A05.1.454.CMB.2.raw
  modified_base (225)..(225): a, c, t, g, unknown or other
  misc_feature (225)..(225): n is a, c, g, or t
  modified_base (632)..(632): a, c, t, g, unknown or other
  misc_feature (632)..(632): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggagtctgtgaagatctnttgcgacgggttcaggagacagtattagcagcgactggctcggctggtgcgcagagtcggcccggggaaggccgtgggaggtggagtgggggatcgataccaagttcgttaggtacgcctaccgtaacgaaaaccgagtaacctacccgtaaccccccgttccttaacccggaaacggggtccccgggtaccaaccccgtacttccgtacgaccgacccgaacgaccgggtaccctaactaccgtaacggtttaacccttaacccgtttacgttaggggtaacggttagggtaacgttaacggtccccgttaagggggaaaccgggtccccgttaccgggaacccaaccggtcctaagttacgttaactttaccgtagtaaccgtagtacgttaagggaacgggttnttacgttagttagtcgggacgttcgttacgttcgggacggggtaaccgtaacggggtaccccgttcgggtaacccgaacccggtccc

SEQ ID NO: 305266 - DNA, 760 bp, Homo sapiens
  misc_feature: GZ8MTXP01DUNII.10.5.A05.1.454.CMB.2.raw
  modified_base (351)..(351): a, c, t, g, unknown or other
  misc_feature (351)..(351): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaaggccgggagtctgtagaagatctcttgcacgggttcaggagacagtattagcagcgactggctcggctggtgcgcagacgtcggacccggggaagccgtggagtggagtggggatcgatctaagtcgttaggacgctacgtacgaaacncgtaactacccgtaacccccgttccttaaccggaaacgggtcccgggtaccaaccgtaacttccgacgaaccggcccgtaacgtacggttacccaattaccgaaacggttaaacccttaacccgttaacggttagggtaaaccggttagggtaaacgtttaacggacccgttaacgggggaaaaccgggtccccggttaaccggaacccgaacccgtacccgttaagttaggtttaaacctttaaccgttaaggttaaaccgtaaacgggttaccggtttaaaggggtaaaccggggttatttaaccttaagttttaaacggtcgggaccggttacggttacgttaaccggggtcgggggaaccgtaaccggggtaaccccgttcgggtaacccttaacccggtccccg

SEQ ID NO: 305267 - DNA, 757 bp, Homo sapiens
  misc_feature: GZ8MTXP01CI2QT.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcaggaggtagaaaaacggcccggggatctgtagaagatctcttgcgtacgggttcaaggagacgagtattagcaggcgagtggctcggcgtggtcgcgccaggacgtcgggcccgggaaggccgtgggaggtgggaggtggggataccgaatcgtaaagttcgttaggacgtcgttaccctaacggaaaaccgacgtaaccctaacccgtaacccccgttaccgttaacccggaaacgggtcccgggttaccaaccctacgtaccgtacgaccggacccgaacgtacggtacccaattaccgaacgttaacccttaaccgtacgttgggtagtacgtaacgttaccggccgttaggggaacccgggtacccgtacccgggaacccgtaacccgtacccgttaagttacgtttaaacgttaaccgttacggtaaccggtaacggttaacggttaacgggtaaaccggggttatttacgttaagtttacggcgggttacgttcggttacggtccggtacggggtaacccgacggggtaaccccttcggggttaacccaaccccggttccc

SEQ ID NO: 305268 - DNA, 864 bp, Homo sapiens
  misc_feature: GZ8MTXP01DOAIG.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccgggatctgtgaagatctcttgcacgggttcaggagacagtattagcagcgactggctcggctggttgcgccagagtcggaccccgggggaagccgtagggacggtagggagttgggggatccgaagtacgtaaagttccgtttagggtagtccttaccgtacggtaaaaccgtagtaacccgttaaccccgaaacccccccggtttacccgtttaacccggaaaacgggggtcccccgggggttacccaaaccccgtaacgttcccgtacccggtaaccggaccccggtaaccgtaaccgggttacccgtaaacttaccgtaaacgggtttaaaccttaaccccgtttaacggtttacggggtaaggttacgggtaacgtttaacgggtaccccgttagggggtaaaacccggggtcccgttaaacccgggaaccgtacccggtaccccgttaaagttaccgttaaacgtttaccggtaacggttaaccggtaaacggttaaaccggttaacggggttaaaccggggggttaactttaccggtttaaacggtttaagtccggggttacgggttccggttaaacggttcgggttaccgggggaacccggtaaccgggggtaaccccgttcggggtaaccccgttaaccccgggttccccg

SEQ ID NO: 305269 - DNA, 676 bp, Homo sapiens
  misc_feature: GZ8MTXP01ECDPR.10.5.A05.1.454.CMB.2.raw
  modified_base (450)..(450): a, c, t, g, unknown or other
  misc_feature (450)..(450): n is a, c, g, or t
  modified_base (477)..(477): a, c, t, g, unknown or other
  misc_feature (477)..(477): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtgacccagtctccataactccctggctgtgtctcgtgggcgaggacgggccaccatcagctgcaggtccagccagagtgttctcttacaacaagaaacaaagtaaaggaattagttagcttaggtaccagacaacgaaaccaggactagtacctacctaaagctgtctactactttacgcgggactaacggtacccggaacccggggacgtccccgggggtccctacggaccgtattcgaggtcggaccgagggtcggggtcagggactagtaacttcgactcctacacctaatccaaacncgcctaggacctaggctaagaaacgtnttagggtcggtactttaaggtttttactttaccgtacggtaaactaaaccgttagtttactttacccgttttcttacccgggtaccggttacgggttaccgggtaacccggtaaccgaaacgggggtaaccgttaaagggtacgtaaccttaacgaaacggttaccgtgggtacgctagccttactcgttcgttaaccg

SEQ ID NO: 305270 - DNA, 736 bp, Homo sapiens
  misc_feature: GZ8MTXP01COXKH.10.5.A05.1.454.CMB.2.raw
  modified_base (307)..(307): a, c, t, g, unknown or other
  misc_feature (307)..(307): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctcgtgggcgagagggccaccatcagctgcaggtccagccagagtgttctcttcaacagaaacaataaggaatgttagcttggtaccagcaagaaaccaggacagtcctcctaagctgctcatttacgngggcagtccggacccgggaagtcccgggggtcctcggaccgtattcgaggtcggccagggccggggttcgtagggggaaccaggtaaacttccgaaaccttccgtacccaaccctaattacccgaaaaccgtacggccccgttaggaccgtaagggtcccttaagggaaacgtagttcgggtacgggtaccgtttaaggttttttacgttttccgtacggttacctaaaccgttaggtttaaccttttcccgtttttacccgtttccggttaccccgggttagggtaacccgggttttaacccggggaacccgttaaaacggggggtaccccgaaagggggtttacggaaacccgttacccggttaaaaaccggttaccggttgggtacgggtccttacggacccttaccctaacgtttccgttaaccg

SEQ ID NO: 305271 - DNA, 568 bp, Homo sapiens
  misc_feature: GZ8MTXP01D6SUQ.10.5.A05.1.454.CMB.2.raw
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (479)..(479): a, c, t, g, unknown or other
  misc_feature (479)..(479): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagccggggagtctgtgaagatctcttgcacgggttcaggagacagattagcagcgactggctcggctggtgcgccagatggcccggggaagcctggagtggatgggggatcatcaatcttggtagctctagaaacagactaccaaccccgtcttccgaaaggcccgggtacaccatcncagccganaggtcatcagttactactactggatggattagcctggaacggcctcggacaccgccatgtacttactgtacgagtcgttaaggaacggggttnttcgttagttacgtgggcgttcggttaacgtcggttacgggggcccgtaacgggggtaaccccttgggtaacccgaaccccggtccccg

SEQ ID NO: 305272 - DNA, 759 bp, Homo sapiens
  misc_feature: GZ8MTXP01DU63I.10.5.A05.1.454.CMB.2.raw
tcagcatagtagtgcacgaccggtgctcgatttagatagatagacagggggtctccctcactgcccagctgggatctcagggcttcatttttctgtcctccactatcatggggtcaaccgccatcctcgccctcctcctggctgttctccaaggagtctgtgccgaggtgcagctggtgcagtcgggagcaggaggtagaaaagccggggagtctgtgaagatctcttgcgtacgggttcaggagacagtattagcagcgactggctcggctggtcgcgccaggacgtcggaccccgggggaaggccgtagggaggtaggagtgggggatcgaatcgaaattcgttaggtacgtctaccgtacggaaaaccaggtaacctaaccccgtaaacccccgttccttaacccggaaacgggtccccggggtaccaacccgtactcctaccgaacggacccgaacgtacggtacccaattaccgaacggttaacccttaaccttaacgttagggtaagttcggtaacgtttacgacccgttaggggaaaccgggtccccgttaccgggaaaccctacccggtaccctaagttacgttaacgtttaacgtacggttaacgaacggttacggttaacgggaaacggggttattttaccgttaagtttaacggtcgggttaccggcggttaacggttccgggtacgggggtaaccccgtaaacgggggtaaccccgttcgggtaaccccgttaaccccggttccccg

SEQ ID NO: 305273 - DNA, 768 bp, Homo sapiens
  misc_feature: GZ8MTXP01BNUKX.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagtatttagcagcgactggctcggctggttgcgccagagtggcccggggaagccgtggagtggagtggggatcatcaatcgttggacgctcctagaaacagactacctaaccccgtccttccgaaacgggtcccgggtacaccctagtcctacgacgtcccgacgacgggtcccaagtaccaaggttaacccttaacccgttaacgtttacggggaacgttagggtaacgtttacggtaccccgttacgggggaaaccggggtaccccgttaccggggaaacccgtaccccggtaccccgtaagtttacggttaaaccgttttaacgtacgggttaaacccggtaaagggttaacccggtttaacggggtaaaacggggggtttacttttaacccggtttaaacgtttaaggttacgggggttcccggttaccgggttaacgttcccgggggttacgggggaaccccggtaacccgggggtaaaccccgtttccggggtccccgttaaacccccgggttcccccg

SEQ ID NO: 305274 - DNA, 576 bp, Homo sapiens
  misc_feature: GZ8MTXP01D4MXB.10.5.A05.1.454.CMB.2.raw
  modified_base (330)..(330): a, c, t, g, unknown or other
  misc_feature (330)..(330): n is a, c, g, or t
  modified_base (509)..(509): a, c, t, g, unknown or other
  misc_feature (509)..(509): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggagtctgtgaagatctcttgcacgggttcaggagacagtattagcagcgactggctcggctggtgcgccagagtggcccggggaggccgtggagtggagtggggatcatcaattcgttgganctctacgaaacagactacccgaaccccgttccttccgaaggcccgggtacaccgatctcacgccgacgacggtcatcagtactactacgtgagtgattagcctagggaacggccgtacggaccaccggcctaagttcggtaacttacgtgtaaccgtagtacgttaaggtaacgggttnttcgttagttagtggcgcgttagtccggtggggaaccgacggggtaccttcgggtccaaccggtccc

SEQ ID NO: 305275 - DNA, 570 bp, Homo sapiens
  misc_feature: GZ8MTXP01DEW7Y.10.5.A05.1.454.CMB.2.raw
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
tcagcatagtagtgcacgaccggtgctcgatttagatagatagacaggggctacaacaggcaggcaggggcagcaagatggtgttgcagacccaggtcttcatttctctgttgctctggatctctggtgcctacggggacatcgtggtgacccagtctccagaatccctggctgtgtctctgggcgagacggccaccatcagctgcaggtccagccagagtgtctctacaacagaaacataaggaatgttagcttggaccagacaagaaaccaggactagtctcctaaagctgctcaatttacggnggacacgtccggaaccggacgtccggtcctcgactatcgagtcgacgaggcggtntagggacaagtaacttcactctacaccacacaacacgccgtagacgtaggactaaggaagtagtaggtaggtacgtttaagttttacttcgtagtactaaactagttacttcgtttcgtccgtcgtacgtacgtcggaacgaacgggtacgaacggtagtaacttaaacgaacgttaactggtacgcgtcgacttacctaacgttcgtg

SEQ ID NO: 305276 - DNA, 549 bp, Homo sapiens
  misc_feature: GZ8MTXP01E1ZIE.10.5.A05.1.454.CMB.2.raw
  modified_base (178)..(178): a, c, t, g, unknown or other
  misc_feature (178)..(178): n is a, c, g, or t
  modified_base (496)..(496): a, c, t, g, unknown or other
  misc_feature (496)..(496): n is a, c, g, or t
  modified_base (517)..(517): a, c, t, g, unknown or other
  misc_feature (517)..(517): n is a, c, g, or t
  modified_base (541)..(541): a, c, t, g, unknown or other
  misc_feature (541)..(541): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtncagtcgggagcagaggtagaaaaagcccgggggatctgtgaagatctcttgcacggggttcaggagacagatttagcagcgactggctcggctggtgcgccagatggccccgggggaaggcctgggagtggatgggggatcatcaatcttggtagctcctagaaaccagactacccaaccccgttccttccgaaagggcccgggtcaccatctcacgcccgacacggtccatcagtacctacctactggagtgattagccgtgggaacgcctcggaccaccgccatgtattactgtacgagtacttggaacggggttntcttagttatggcgcgatcgnggggccgacgggacccttggtccncccgtccc

SEQ ID NO: 305277 - DNA, 636 bp, Homo sapiens
  misc_feature: GZ8MTXP01CE1T1.10.5.A05.1.454.CMB.2.raw
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagagggccaccatcagctgcaggtccagccagagtgttctcttacaacaagaaacaataaggaattgttagcttaggtaccagacagaaaccaggacagtctacctaanctgctatatttacgngggcacgtaccggacccgggtaacgtcccggggtcctcgaccgtatcgagtcggcagggcggtcgtagggactaagtaacttccaacgtcaccaaccactaccgaaacacgccctaggacgtaagggctaaggaagtagtggttacgggactttaagttttattcgtacgtactaaacgtgtttactttccttttccgttccgttaccggttcgggttacccggttaaccgggaacccgttaaaggggtaaacccgaaggtaaccggaacttaaaccgaaacgttacgtgggtcgcgttacgaccttactaacgttcgttaac

SEQ ID NO: 305278 - DNA, 700 bp, Homo sapiens
  misc_feature: GZ8MTXP01ADBBD.10.5.A05.1.454.CMB.2.raw
  modified_base (603)..(603): a, c, t, g, unknown or other
  misc_feature (603)..(603): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagccggggatctgtgaagatctcttgcgacgggttcaggagacagtatttagcagcgactggctcggctggtgcgccagatcgggaccccggggaaggccgtggggagtgggacgtgggggatcgagtacaagttcgttaggtacgtcttaccgttaacggaaaaccgtaggtaacctacccgtaaaccccccgtttcccgtttaacccggaaacggggtccccgggtaccaacccgtactcctacgacggacccgtacgacggtccagtcaacgttacctaccgttacgttgggacgttagtaagttacgaccgttacggggaacggccgtaccggaccgtacccgccgtagtacgttacttacgtgtaccggtaacgttcggttaagggaaaccgggtttntttaccgttaagtttacggacgggttcgttcggttacgttcggggtcgggggcccgtaacggggtaccccgttcggtaacccgcccggttaaccccg

SEQ ID NO: 305279 - DNA, 588 bp, Homo sapiens
  misc_feature: GZ8MTXP01AJXHI.10.5.A05.1.454.CMB.2.raw
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (579)..(579): a, c, t, g, unknown or other
  misc_feature (579)..(579): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtcgacccagtctccagaactccctggctgtgtctcgtgggcgagaggccaccatcagctgcaggtccagccagagtgttctctcaacagaaacaataaggatgttagcttaggaccagcaagaaaccnggacagtctactaagctgctctatttacgngggctacgtccggacccgggtagtccccggggtcctcgaccgtattcgagtcggacaggtcgggtctggggacaggtaacttcactcctacaccgatacaacacgcctagccgaggctaggaagtgtggtcggacttagttttatttcgtagttacaacgttagttactttcctttcgtccgttccggtacggtccgttccggaccgttaaacgggaccgttaagggtacggaaccttacgaaacgttacgtggagtccgtagacccttactnttccgttcg

SEQ ID NO: 305280 - DNA, 743 bp, Homo sapiens
  misc_feature: GZ8MTXP01BPGRX.10.5.A05.1.454.CMB.2.raw
  modified_base (653)..(653): a, c, t, g, unknown or other
  misc_feature (653)..(653): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaacgccggggatctgtgaagatctcttgcgtacgggttcaggagacagtattagcagcgacgtggcgtcggcgtggtgccgccgaggacgtcgggaccccggggaaggccgtgggagtgggagtgggggatcgagttactaagttcgttaggtacgcgtaccgtaacgaaaccaggtaacctacccgtaacccccgttccttaaccggaaacgggtcccgggttaccaccgtataccgtacgaacgcccgaacgtaccggtaccaactaccgtaacgtaaccgttaacccgttaacgttagggaacgttcgggtaaacgtttacggacccgttacgggggaaacgggtccccgttaccggaacccgaacccgggtaccctaagggttacgttaaacgtttaccgtaacgggttaaccgtaacgtaaaccggtttaacgggtaaaccgggggttntttaaccgttagtttaacgcgggacgttcggttacgttcgggaccggggtaaccgaaccggggtacccttcggtcccgaacccgttcccg

SEQ ID NO: 305281 - DNA, 575 bp, Homo sapiens
  misc_feature: GZ8MTXP01AGM67.10.5.A05.1.454.CMB.2.raw
  modified_base (305)..(305): a, c, t, g, unknown or other
  misc_feature (305)..(305): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttacaacagaaacaataaggatgttagcttggaccagcaagaaaccaggacagtctactaagctgctctatttacgngggcacgtccggacccgggaatcccgggggtcctggaccgattcgagtggacaggcgggtctggggacagtaattcactctacacatacaacagcctgcgaggctagaagatggtggctagtttatttctagtactaactagttacttccttttctccgttccggtggtaccggtttcggaccgaaagggtacccgttaaagggtacggaaaccttacgaaaacggttaccgtaagggtcgcgttcggacgttaccctaagttccgttcg

SEQ ID NO: 305282 - DNA, 666 bp, Homo sapiens
  misc_feature: GZ8MTXP01BUGFE.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagccgggagtctgtgaagatctcttgcgacgggttcaggagacagtattagcagcgactggctcggctggtgcgccagagtcggcccggggaaggccgtgggaggtggagtgggggatcgatcgaattcgttggtagctactagaaacagactaccaaccccgtccttccgaacgggcccgggtcaccatctcgacgccgacgacggtaccatcagtaccttaccgtagttggagtgattacgccttaggggaacggtcccgtaccggacctacccgaccctagttacgttaacgtttacgtacggttaaccgaacggttaacggtttaacgggtaaacgggggttactttaccgtttaagttaacgttcggggttaccggttcggttacgttccggggttccgggggaacccgtaaccgggggtaaccccgttacggggtaaccccgttaaccccgggttccccg

SEQ ID NO: 305283 - DNA, 806 bp, Homo sapiens
  misc_feature: GZ8MTXP01ERW8J.10.5.A05.1.454.CMB.2.raw
  modified_base (154)..(154): a, c, t, g, unknown or other
  misc_feature (154)..(154): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggngtctgtgccgaggtgcagctggtgcgagtcgggagcagaggtagaaaacggccgggatctgtagaagatctcgttgcgtacgggttcaggagacgagtattagcgagcgacgtggctcggcgtggtacgccggaccgagtacggtcgggaccccgggggaaggtccgtaggggtaggtgggtaaggtgggggataccaagttacaaagtttcgtttaggtacgtcgttacccgtaacggaaaacctaggtaacctacccccgtaaacccccgttacccgttaacccggaaacgggtccccgggtacaccccgtacttccgaccgacgacccgtacgtacggtcctaactaccgtaacgttaacccgtaaccttacggttagggacggttacgtaacgttacggtacccgtaacgggggtaaaccggtcccgtaccgggaaccctaaccccggtaccgttaagttaaccggtttaaacgtttaccgtaacgggttaaacgtaaccggtaaccggtttaagggtaaacccgggggtttatttaaccgttaaaggttacgggtacgggttccgttacggttaacggtccggggtaccgggtaacccgggtaacggggtaaccccgttgggtaaccccgttaacccgggtcccccg

SEQ ID NO: 305284 - DNA, 622 bp, Homo sapiens
  misc_feature: GZ8MTXP01CJHKO.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggagtctgtgaagatctcttgcacgggttcaggagacagtatttagcagcgactggctcggctggttgcgccagatggcccggggaagccgtggagtggagtgggggatcatcaattcttggtagctcgtagaaaccagtactaccgaaccccgttccttccgaaagggtcccgggtcaccatcctcacgccgacacggtccatcagtacctaccttacgttaggagtggtactttacgccgttagggaacgggtccgtaccgggaccgacccgccagttacgttacttacgtgtaacgagtacgtaagggtaacggggttatttcgttagtttagtgggcgttcgttaacgttccggtcgggggtaacccgtacggggtaccccgttagggtaaccccgaacccggttcccccg

SEQ ID NO: 305285 - DNA, 530 bp, Homo sapiens
  misc_feature: GZ8MTXP01BN8VI.10.5.A05.1.454.CMB.2.raw
  modified_base (331)..(331): a, c, t, g, unknown or other
  misc_feature (331)..(331): n is a, c, g, or t
  modified_base (366)..(366): a, c, t, g, unknown or other
  misc_feature (366)..(366): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagccggggatctgtgaagatctcttgcacgggttcaggagacagattagcagcgactggctcggctggtgcgccagatggcccgggaagcctggagtggatgggatcgatcaatcttgagctcagaaacngactaccaacccgtctcaaggccggtacaccatcncagcacagtcatcagtactactatgatagatagcctgaacggctacggacacgcatntaattnggtacagacttaaggaacgggttattcttagtttaaggcggttacgcgttacgtcgggtacggggaaccgtaacgggtaccgttcggtcccgaacccgtcc

SEQ ID NO: 305286 - DNA, 552 bp, Homo sapiens
  misc_feature: GZ8MTXP01EV0HN.10.5.A05.1.454.CMB.2.raw
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagcatagtagtgcacgaccggtgctcgatttagatagatagacaggggctacaacaggcaggcaggggcagcaagatggtgttgcagacccaggtcttcatttctctgttgctctggatctctggtgcctacggggacatcgtggtgacccagtctccagaatccctggctgtgtctcgtgggcgagaggccaccatcagctgcaggtccagccagagtgttctntcaacagaaacaataggatgttagctgacngcagaaacnggcagtcnctanctgctnatttacgnggcagcgaccggagtccggctcgactatcgagtcggacaggcggtagacgggacagtacttcactcacaactanacaacncgcctagacgaggtctaaggaatgttacggtgtaacgtttagttttattcgtaggtaaccaaagtagtttactttctttccgtcgttccggtagggtaccgttcggacggaacgggtacttaaaggttacgaaaccttacgaaacggttagtggtacggctcgacccttactcgttcgtg

SEQ ID NO: 305287 - DNA, 671 bp, Homo sapiens
  misc_feature: GZ8MTXP01BALUU.10.5.A05.1.454.CMB.2.raw
  modified_base (317)..(317): a, c, t, g, unknown or other
  misc_feature (317)..(317): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtgacccagtctccagaactccctggctgtgtctcgtgggcgagacggccaccatcagcctgcaggtccagccagagtgttctcttacaaacagaaacaataaggattgttagcttggtaccagacaagaaaccaggacagtcctactaagctgacctctatttaccgngggactacgtaccggaccccgggtaagtcccgggggtcccctaggacccgtagttcgaggtgaccgaggtccgggtcgtaggggacctaggtaacttccaacttcctaccaacctataccaacgacgccctaggcgtaaggctagaaagtagtggtacgggtacttaaggtttttacttaccgttacggtactaaaccttaggtttactttccgtttttaccttccggttcccggttacggggtaaccggtttcccgggaaaccggttaaacggggtacccgttaaaggggtacggtaaacccttaacggaaaccgttacgtggttacgctcggaccttacgtaacgttcttcg

SEQ ID NO: 305288 - DNA, 556 bp, Homo sapiens
  misc_feature: GZ8MTXP01BH5YT.10.5.A05.1.454.CMB.2.raw
  modified_base (224)..(224): a, c, t, g, unknown or other
  misc_feature (224)..(224): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgaggacgggccaccatcagctgcaggtccagccagngtgttctcttacaacagaaacaataaggtaattgttagcgttaggtaccagacaagaaaccaggacagtcctacctaagctgtctactagttttacgcgggctaacgtccgggaaccccgggtacgtcccgggggtcctacggaccgtattcgaggtcggacgaggcgggtcgtagggacagtacttcactctcacatcaacngctagcagcagangtgtggacttagttttacttctagtacaacgtnttacttctttctcgtcggtcggtcgtcgacgagggtacaggtacgaacttacgaacgacgtgtacggctcgcacctgttctcg

SEQ ID NO: 305289 - DNA, 650 bp, Homo sapiens
  misc_feature: GZ8MTXP01BM10L.10.5.A05.1.454.CMB.2.raw
  modified_base (337)..(337): a, c, t, g, unknown or other
  misc_feature (337)..(337): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaacggcccggggagtctgtagaagatctcttgcgacgggttcaggagacagtattagcagcgactggctcggcttggtgcgccagagtcggcccggggaagccgtggagtggagtggggatcgatcaattcgttgganctccagaaacagtactacccgaccccgtctccgaagggtcccggtacaccatctacgacgccgacacggtccagtcacgtaactaccttacgttggagttagattacgccgttaggggaacggtccgtaccggaacctaccggaccctagttcgttaacttacgtaggttaaccgaacgtcggttaagggaaacggggttacttacgttaagttaacggtcgggttacccggttcgttaacggttccgggtacgggggaacccgtaaccgggggtaaaccccgttgggtaaccccgttaaccccggttccccg

SEQ ID NO: 305290 - DNA, 652 bp, Homo sapiens
  misc_feature: GZ8MTXP01CRL8L.10.5.A05.1.454.CMB.2.raw
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
  modified_base (583)..(583): a, c, t, g, unknown or other
  misc_feature (583)..(583): n is a, c, g, or t
  modified_base (596)..(596): a, c, t, g, unknown or other
  misc_feature (596)..(596): n is a, c, g, or t
  modified_base (603)..(603): a, c, t, g, unknown or other
  misc_feature (603)..(603): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcggagcagaggtagaaaaggcccgggagtctgtagaagatctcttgcgacgggttcagganacagtattagcagcgactggctcggctggtcgcgccagacgtcggacccgggaaggccgtgggagtggagtggggatcgatcaagttcgttaggtatctaccgtacgaaaccngtacctaacccgtaacccccgttccttccggaacgggtcccgggtaccaccgtactccgtacgacgcccgtaacgaccggttaccataccgtaacgttaaccttaccgttacgttagggagttggtaacttacgccgttaggggaaccggtcccgtaaccggacccgacccgtaccgtagttacgttaacttacgtacgtaacgtagtacgtaaggtaacgggttnttacttagttagnggttcgngttacgtcggtacgggccgtaacgggtaccgttcggtcccgccggtccc

SEQ ID NO: 305291 - DNA, 700 bp, Homo sapiens
  misc_feature: GZ8MTXP01EIDMW.10.5.A05.1.454.CMB.2.raw
  modified_base (626)..(626): a, c, t, g, unknown or other
  misc_feature (626)..(626): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgcctcctcctggctgttctccaaggagtctgtgccgaggtgcagctggtgcaggtcgggagcaggaggtagaaaacggccggggagtctgtgaagatctcgttgcgtacgggttcaggagacagtagttagcgagcgacgtggctcggcgttggtcgcgaccgagacgtcggcccggggagccgtagggaggtaggaggtgggggtatccgagttacgtaagtttcgttggtacgcctttacgaacggaaaacctagtaaccctaccccgtaacccccgttacccgttaacccgggaaaccgggtcccgggtacccaacccgtactccccgtacgaacccggaccgaactaccggtacctacgtacctaacgttacctaccgttagttagggacgtagtacgttacgccgtacggggaacggtcccgtaaccggaccgacccgtactcgtaggttaacttacgtacgtaccggtaggtaacgtaacgggtaacgggttnttacgttagtacgtcgggacgttcgacggtcgggtcggaaccggtaacgggacccgttcgtaaccgcccgtccc

SEQ ID NO: 305292 - DNA, 862 bp, Homo sapiens
  misc_feature: GZ8MTXP01ARQ0G.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcgaggtcgggagcgagaggtagaaaaacggccggggagtctgtagaagatctcttgcgtacgggttcaggagacagtattagcgacgcgacgtcggcgtcggtcgtggtcgccgtacgaggacgtcgggacccggggaggccggtgggaggtggaggtgggggactacgtatacgtaagttcgtttaggtacgtcgttaccgtaacggaaaaccgtaagtaaccctaccccgtaaaccccccggttacccgttaacccggaaacccggggtccccgggtacctaacccgtacgttccgtaccgaaccggacccgaaccgtaccgggtaccctaacgttaaccgtaaacgttaaccccgttaacccgttacggtttacgggaacggttacggttaacgttaccggtacccggtacgggggtaaccggtaccccggttaaccggaacccgaccccggtacctaacgttacggtttaaacgtttaccggtaacggttaaccggtaacggtaaccggtttaaacggggtaaaccgggggtttaattttaacccgttaaaggtttacggttaaccgggggttacgttccggttaaacgggttcccgggggtaaccgggggtaaccccggtaaacccgggggtaacccccggttttccgggaacccccgttaacccccggttaacccccg

SEQ ID NO: 305293 - DNA, 793 bp, Homo sapiens
  misc_feature: GZ8MTXP01ANCNN.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaaggcccggggagtctgtgaagatctcttgcgacgggttcaggagacagatttagcagcgactggctcggctggttgcgcagagtggcccgggggaaggcctgggagtggacgtgggggatcagtccaagttcgttagggtacgcttccgtaacggaaaccaggtaactaacctaaccccccggttacctttcccggaaacggggtccccggggttaccaacccgtaactttccgtacgaaccggtaccccggtaaacacggggttaacccaacgttacctaaacggttaaaccccttaaacccgtttaaaccgttcgggggtaaacggtttcgggtaaagttttaaccgggaccccgtttaacggggggaaaccggggtcccccggtttaccggggaaaccccgaccccggtaccctaacgttaggtttaaacctttaaccgttcgggtaaaccgtaacgggttaccgtttaacgggtaaaccgggggttatttaccgttaagttttaagcgggttccgcggttaacgttccgggtacgggggtaacccgaacgggggtaaccccttcggggttaacccaaccgggtccccg

SEQ ID NO: 305294 - DNA, 583 bp, Homo sapiens
  misc_feature: GZ8MTXP01DP9C0.10.5.A05.1.454.CMB.2.raw
  modified_base (448)..(448): a, c, t, g, unknown or other
  misc_feature (448)..(448): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaaacaagaaaacaaataaaggaatgttaagcttagtaccagcaagaaaccaggacagtctacctaaagctgctacatttacgtgggcaatccgaacccgggtaagtcccgggtcctcgaccgattcgagtgcagcgggtctgggacagaattcatctcacatacaaacagcctagcaggctagaaagatgtggcttagtttatttcagtacaaacgngttaactttctttccgttctacccgtggcgttcgaacccgttaaagggggaaacccaaacgggttaggaaaccttaacgaaaacccggaaacttggtacggaaccgttaggaccacctaaacgtttccgttaacg

SEQ ID NO: 305295 - DNA, 769 bp, Homo sapiens
  misc_feature: GZ8MTXP01CFVE5.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcaggaggtagaaaacggccgggagtctgtagaagatctcttgcgacgggttcaggagacagtattagcagcgactggctcggctggtgcgtccagagtcggccccggggaaggcctggaggtcggagtggggatcagtcgtaagttcgttaggtactcgtacccgtacggaaacctaggtaacctaacccgtaaccccccgttaccctttaacccgaaacggggtccccggggttacaccccgtaacgttccgtacgacggacccgtacgtaacgggtccaacgttccgtaaggttaacccttacccgttaacgtttaggggtaacgttacggtaaacgtttacgggacccgtttagggggaaccggggttaccccgttaccgggaacccgtacccgaccccgtaagttcggtttaaacttaccggttacgttaaccggaacggttaccgttaacgggtaacgggggttactttacccggttagtttaacggtcggttaccggttcggttacgttccgggttcggggaacccgtaaccggggtaaccccgttcggggtaaccccgaacccgggttccccg

SEQ ID NO: 305296 - DNA, 752 bp, Homo sapiens
  misc_feature: GZ8MTXP01EGM5V.10.5.A05.1.454.CMB.2.raw
tcagcatagtagtgcacgaccggtgctcgatttagatagatagacatggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaaggcccggggagtcgtgtagaagatctcttgcgacgggttcaggagacagtattagcgaggcgacgtggctcggctggtgccgccgagagtcggccgggggaagccgtggagtggagtgggggactcgagtactaagttcgttaggtacgtcctacgtacgaaaccacggtactaaaccccgtacccccgttccgtttacccggaaaccggggtcccgggttaccaacccgtacgtcctccgacggtacccgacgtaacggtccacttaccgtaacgttaacctaaccgttacgttagggtacgtaggtaacgttacggaccggtagggtaaaccgggtcccgttaccgggaaccgtaaccccggtaccgttaacgttacggtttaactttaaccgttacggttaaaccggtaaacggtaacggtttacgggttaaacgggggttactttaccgttaaagttacgttacgggttcgacggttaaggttccggtcgggggtaacccggaccgggggttaaccccgttcggggttaaccccgtaacccccgg

SEQ ID NO: 305297 - DNA, 603 bp, Homo sapiens
  misc_feature: GZ8MTXP01AONUG.10.5.A05.1.454.CMB.2.raw
  modified_base (532)..(532): a, c, t, g, unknown or other
  misc_feature (532)..(532): n is a, c, g, or t
  modified_base (563)..(563): a, c, t, g, unknown or other
  misc_feature (563)..(563): n is a, c, g, or t
  modified_base (594)..(594): a, c, t, g, unknown or other
  misc_feature (594)..(594): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaaggcccggggatctgtgaagatctcttgcgacgggttcaggagacagtattagcagcgactggctcggcgtggtgccgccgagacgtcggaccccggggaaggccgtgggagtggagtgggggatcatcaatcgttggtatctcctagaaacagactaccaaccccgttctccgaacgggtcccgggtacacccgatcctacgacgacccgacacggtccaagtcctaagtacctaccgttagttcgggagttggtattacgccgtagggaacggtcctacggaccaccgccagtcgtacttacgtggtacgagtcgttggaacgggttnttacgttgtagtcggacgttcgacgttcggngggtcccgacgggtacccgttgggtaacccncccggtccc

SEQ ID NO: 305298 - DNA, 689 bp, Homo sapiens
  misc_feature: GZ8MTXP01B6J3C.10.5.A05.1.454.CMB.2.raw
  modified_base (251)..(251): a, c, t, g, unknown or other
  misc_feature (251)..(251): n is a, c, g, or t
  modified_base (468)..(468): a, c, t, g, unknown or other
  misc_feature (468)..(468): n is a, c, g, or t
  modified_base (608)..(608): a, c, t, g, unknown or other
  misc_feature (608)..(608): n is a, c, g, or t
tcagcatagtagtgcacgaccggtgctcgatttagatagatagacagggggtctccctcactgcccagctgggatctcagggcttcattttctgtcctccactatcatggggtcaaccgccatccctcgccctcctcctggctgttctccaaggagtctgtgccgaggtgcagctggtgcaggtcgggagcaggaggtagaaaaacggcccggggagtctgtagaagatctcttgcgtacgggttcagganacgagtattagctaggcgacgtggctcggcttgggttcgccgaccgaggacggttcgggaccccgggggtaaaggccgtgggggaggtgggaggtagggggtactacgaatacgtaaagttcgttagggtactctaccgtaacgaaactagtacctacccgtaacccccgttccttaaccgaaacgggtcccggtacacctactcacgacgcccganaccggtacataccagttaacctaccgttagtagggacgtagtacttacgcgtacggggaacggtccgtaccggaacctaccggacctaagttacgttacgtacgttacggaacgtacggtacgttaagggaaccgggttnttacgttagttaacggtcgttacgcgttaacgtcgggtacgggaaccgtaacgggaccgttcggtaaccgaacccgtcccg

SEQ ID NO: 305299 - DNA, 687 bp, Homo sapiens
  misc_feature: GZ8MTXP01B6A1E.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaacgcccggggagtctgtgaagatctcgttgtacgggttcaggagacagtattagcagcgatggctcggcgtggttgcgtccagacgtcgggacccggggaaggccgtaggagtggagtgggggatcgatctaagttcgttggtacgtctactaacgaaaccagaactacccgaccccgttaccttacccgaacgggcccggtaccacctactccgtacgacggcccacgtacggtacccagtcgaacgttaacctaaccttacggttagggagttcggtaagtacgccgtaggaacggggtcctccggggaaccacccgtacctagttagttattaacgtacggtacgtaacggtcgttaacgggtaaacgggggtctttacgttagttaacggcgggtccgacggttacttccgggggtaacgggtaccccgggaacggggttaaccccgtcgggttacccgaaccccgttaacccgttccccgg

SEQ ID NO: 305300 - DNA, 709 bp, Homo sapiens
  misc_feature: GZ8MTXP01A4M1W.10.5.A05.1.454.CMB.2.raw
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcggtggtcgacccagtcctccagaactcccgtggctgtgtctcgtgggcgaggacgggccaccatcagctgcgaggtccagccagagttcgttctcttacaacaagaaacaagtaaggtattgttagcgttaggtacagacaagaaaccaggacagtcctaccgtaacgctagtcctacttagtttacgcgggtactacggtacccgggaaccccgggtaacggttccccgggggtacctacggaccgtagttcgaaggtcggaacgcggtcgggtcgtacgggactacgtacttcgacttccacactactacaaacgtcgaccctgacgtacggtacgtaaggaagtgtcgggtacgggtagtttacgtttttcggttacctacggtaacctaaaccgtttgtttcccttttctttccggttaccggtaccgggttaccgggttacggtaacccgggtaacggaaaccgggtaaacccgttaacggggaacccgtaaccgttaaaccggaaaccggttcggtcgggtaccggtaactaccgtacccttaccgtcgttcccgtcg

SEQ ID NO: 305301 - DNA, 647 bp, Homo sapiens
  misc_feature: GZ8MTXP01BIAS5.10.5.A05.1.454.CMB.2.raw
  modified_base (337)..(337): a, c, t, g, unknown or other
  misc_feature (337)..(337): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtcgacccagtctccagaactccctggctgtgtctcgtgggcgaggacggccaccatcagctgcaggtccagccagtgttgttcctcttacaaacaagaaaactaagtaaggtaattggttagcgttacgtaaccagactaacgaaaccaggactagtcctacctaagtctagactactatttaccggngggctacggtccggaaccgggtacgtcccggggtcctacggaccgtatcgaggtcgacgacggtcgggtatacggggactaaggtacttcactccacaacctactacaacgacgtccgtacggacagggtctaagaagtgtaggtcgtacgtttacgttttagttctactactaaacttgtttactttccgttttacttccggtaccggttcggacggtttaaccggaacggttaacgggaaccttaaggggtaccgtaacttaccgttaaagttacgtcgtaggtctcgtacacctaagttcttaaccg

SEQ ID NO: 305302 - DNA, 764 bp, Homo sapiens
  misc_feature: GZ8MTXP01AXMEB.10.5.A05.1.454.CMB.2.raw
  modified_base (154)..(154): a, c, t, g, unknown or other
  misc_feature (154)..(154): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggngtctgtgccgaggtgcagctggtgcaggtcggagcaggaggtagaaaaacggccggggagtctgtagaagtatcttcttcgacgtacgggttacgaaggagactagtatttagcagcgacgtggctcggcgtggtgcgcagcgtcggacccgggaggccgtggaggtggacgtggggactacgacttacgtaaacgttcgttaggtacgccttaacgtacgaaactaacgtactaccccgtaacccccgttaccttaacccgaaaccgggtcccgggtacaaccgtactccgtacgaaccgcccggaacgtaccggtacctagtaccgttaacgttaacccgttaaccgttaacggttcgggtaacggttaggtaacgttacggtacccgtaacgggggtaaccggtacccggttaccggaacccgaccccggtactaacgttaggtttaacttaacggttacggtaacgtacgggttacgttaaggggaaaccgggtttatttacgttaaacgttacggttcgggccgttcgttaaccgggttccgggaccgggggtaaccgtacccggggtaccccgttacgggttaaccccgttaacccgtccccgg

SEQ ID NO: 305303 - DNA, 773 bp, Homo sapiens
  misc_feature: GZ8MTXP01BM785.10.5.A05.1.454.CMB.2.raw
  modified_base (277)..(277): a, c, t, g, unknown or other
  misc_feature (277)..(277): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcgagaggtagaaaaacggcccggggagtcgtgtagaagtatctcgttgcgacgggttcaggagacagtattagcagcgatggctcggngtggtgcgccagacgtggacccggggaggccgtaggagtggagtggggatcatctaagttcgttaggtacgcttaccgtacgaaaacctaggtacctacccgtaacccccgttacccttaaccggaaccgggtcccgggttaccacccgtacgtaccgtacgacggaccccgtaacgtaccggtaccctaacgtaccgtaacgttaaaccccgttaacccgtttagtttaccgggggaaagttacgggtaacgtttaacgggccccgtttaagggggaaacccggggttcccgttaacccgggaaccctaaccccggtccgttaaagtttcggtttaaacgtttaccgtagggtaacccggtaaggtaaccggtttaacgggtaaacggggttactttacggttaaagttcggttcgggacgttcgttacggttccgggccgggggtaacccgtaaacggggtccccgttggggtaaccccttcccgggtcccccg

SEQ ID NO: 305304 - DNA, 744 bp, Homo sapiens
  misc_feature: GZ8MTXP01B94L6.10.5.A05.1.454.CMB.2.raw
  modified_base (154)..(154): a, c, t, g, unknown or other
  misc_feature (154)..(154): n is a, c, g, or t
  modified_base (386)..(386): a, c, t, g, unknown or other
  misc_feature (386)..(386): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggngtctgtgccgaggtgcagctggtgcgaggtcggggagacgaagggaagggtaaggaaaaaacggcccgggggtaagttcgtaggtagaaagtacttcttcgttggacgtacggggttacgaagggagacgtaagtactttagcgagcgacgtggcgtcggcgttggtcgcgccgagacgtcgggaccgggagcgtgggagtggagtgggatcgatacgtagttcgtggtacnctaccgacgaaacagtaacctacccgtaccccgttaccgtccggacgggtcccggtacaccgactcgcgacgaccgactacggtaccacgtactaacgttaaccgtaccttaggttagggacgttacgtaagttaaccggtacccgtagggggtaaaccggtccccgtaaccgggtaaccctaacccggtacccgttaagtttacggtttaaccgttttaacgtaacgggttaacgtaacgggttaacggtttaaacgggaacggggtttactttacggttaagtttaggcggttacgttgttacgtcgggtacggggaacgttaaccgggtccgttcggtcccgaaccggttccccg

SEQ ID NO: 305305 - DNA, 640 bp, Homo sapiens
  misc_feature: GZ8MTXP01DT7ER.10.5.A05.1.454.CMB.2.raw
  modified_base (248)..(248): a, c, t, g, unknown or other
  misc_feature (248)..(248): n is a, c, g, or t
  modified_base (628)..(628): a, c, t, g, unknown or other
  misc_feature (628)..(628): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcaggaggtagaaaaggcccgggatctgtagaagtatctcgttgcgtacgggttcaagganacgagtattagcgagcgacgtggcgtcggcgttggtcgacgaccgagacgtcgggacccggggaagtccgtagggaggtaggagtgggatcgatacgtaagttcgttaggactctacgtacgaaacagtacctacccgaaccccgttctaaccgacgggtcccgtacacctatcctacgacgaccgacgtacggtaccatctaacgttacctaccgttagtaggagtagtaatacgaccgtaggggaaccgccgtacgaccaccgactagttgtaacttcgtagtaacgtagtacgttaacggaacggttattacgttagtacggtcggacgttcgttacgttcggacggggccgaaccgggtacccttcgggtaacccncccggtaacccc

SEQ ID NO: 305306 - DNA, 754 bp, Homo sapiens
  misc_feature: GZ8MTXP01EV5DO.10.5.A05.1.454.CMB.2.raw
tcagcatagtagtgcacgaccggtgctcgatttagatagatagacagggggtctccctcactgcccagctgggatctcagggcttcatttttctgtcctccactatcatggggtcaaccgccatcctcgccctcctcctggctgttctccaaggagtctgtgccgaggtgcagctggtgcgaggtcggggagcgaggaggtagaaaacggcccggggagtctgtgaagtatctcgttggtacgggttcaggagacagtattagcagcgtacgtggctcggcgtggttgccgacgagacgtcgggacccggggaaggccgtggaggtggagtggggatcgattacaagttcgttaggtagtctacgtaaccgaaaccagtacctaacccgtacccccgttaacccgttacccggaacgggtcccgggtaccacccgtactccgtacgacggacccgaacgtacggtacctaacgtaccgtaacgttaacccgttaacccgttacggtttagggaacggttacggtaacgttacggaccgttaacgggaaaccgggggtccccgttaaccggggaccctaaccccgtacgtaagttacgtttaacgttaccgttaggtaaccggtaacgttacggttagggtaaacggggtttactttaggtaagtttaggtcggtacggttacggttacgttcgggtccgggggacccgtaacgggggtaaccccttcggttacccgtcccgttccgttccccgg

SEQ ID NO: 305307 - DNA, 898 bp, Homo sapiens
  misc_feature: GZ8MTXP01AF238.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagcgtggtgcgaggtcgggagcgaggaggtagaaaacggcccgggagtctgtagaagtatctcgttgcgtacgggttcgaggagacagtattagcagcgactggcgtcggcgttggttcgcgccgaggagtcgggaccccggggaaggcccgtagggacggtaggagtgggggatcgtaagtacgtaaagttcggtttaggtacgtccgttacccgtaacggaaaaccgtaaggtaaccctaaccccggtaaacccccccgttacccgttaacccggaacgggtccccggggtaccacccctacgttcccgtacgaacccggacccgaacgtaccggtaccctaacgtacccgttaaacgttaacccgtttacccgtttaacggtttacggggtaacgggttacggttaaacgtttaccggggtaccccgttaacggggggtaaaccccggggtacccccggtttacccggggaaaccccgtaccccggtaacccgttaagtttaaccggtttaaaccgtttaaccggttaccgggttaaaccgggtaccggtttaaacccgggttaacgggggttaaaaccggggttactttttaacccggtttaaagtttaacgggtacccggggttcggttacccgggttacggttcccggggtaccgggggtaaccccggttaacccgggggtaccccgttacggggttcccccgttaaccccgttccccccgg

SEQ ID NO: 305308 - DNA, 730 bp, Homo sapiens
  misc_feature: GZ8MTXP01A36SU.10.5.A05.1.454.CMB.2.raw
  modified_base (315)..(315): a, c, t, g, unknown or other
  misc_feature (315)..(315): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtcgacccagtctccagaactccctggctgtgtctcgtgggcgaggacggccacatcagctgcgaggtccagccagtgttgttctctacaacaagaaacaagtaaggaattgttagcttaggaccagacaagaaaccaggacagtctacctaagctgctatattcgnggcacgtccggaaccggtacgtcccgggtcctacgacctatcgaggtcggacagggcgggtcgtagggaactagtacttccacgtccctacaaccgtataaccgaaaccgtacgtccgtacggtacgacgggtacttaaggaaagtcgttacgggttacggttaccgtttaagttttttacgtttacccgttggtaaaccctaaacggttactttaacccgttttccgtttttaccgttcccgggttaccggtttacggggttaaccccggtttaaccgggggaaacccggaaaccgggggttaaccccgttaaagggggttaaacccggaaacgttaaacccgaaaacgggttaacgttcggggttacgggaaccttaaccggacccttaacgttaaccgtttccgtttaaccg

SEQ ID NO: 305309 - DNA, 637 bp, Homo sapiens
  misc_feature: GZ8MTXP01AZC6C.10.5.A05.1.454.CMB.2.raw
  modified_base (286)..(286): a, c, t, g, unknown or other
  misc_feature (286)..(286): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaggccgggagtctgtgaagatctcgttgcgtacgggttcagggagacagtagttagcagcgactggcgtcggctggtgcgccagngtcggcccggggaagccgtggacgtggagtgggatcatcattcgtgtagctactacgaacacgactaccctaacccgtcccgttcgaacgggtcccgggtacaccgtacgtctacgacgtccgaacgacggtccagtacgaattacctacgttaacgttgggaagttacgacttagcccgtaggggaacgtccgtaccgggaccacccgctaacgttagttacgttacgtacggtacgaacgttacgtaacgggtaacgggttatttacgttagtttacgcgggacgttcgttacggtcgggtcgggaacccgacccggggtacccgttacgtaaccccgttccgtccccg

SEQ ID NO: 305310 - DNA, 775 bp, Homo sapiens
  misc_feature: GZ8MTXP01DYLPU.10.5.A05.1.454.CMB.2.raw
  modified_base (244)..(244): a, c, t, g, unknown or other
  misc_feature (244)..(244): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcggagcgaggaggtagaaaaacggcccgggagtctgtagaagatctcttgcgtacgggttnaggagacagtattagcagcgactggctcggcgtggtcgcgccagngtcggaccggggagcgtgggagtggagtggggatctanctaagttcgttaggtacgtctaccgtaagaaaccagaacctacccgtaacccccgttccgttaaccggaacgggtcccgggtaccaccgtaactccgtacgaccgacccgtaacgacggtacccaattaccgtaaacggttaaccccttacgttaaccggttaggggtaacgttacgggtaaacgttaccggtcccggttaaacgggggaacccgggtccccgtaaccgggaaccccgtaaccccggtacccgttaagtttaccggttaaacggtttaccgttaacgggtaaacccgtagggtttaaccccggttaagggggtaaacccgggttatttaccgtttaagtttaacggtcgggttaccgttcggttaaacgtcccggggtacggggtaacccgtaaccggggtaaccccgttcgggtaacccgttaaccccggttccccg

SEQ ID NO: 305311 - DNA, 751 bp, Homo sapiens
  misc_feature: GZ8MTXP01E08VJ.10.5.A05.1.454.CMB.2.raw
  modified_base (249)..(249): a, c, t, g, unknown or other
  misc_feature (249)..(249): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcgaggtcgggagcgaggaggtagaaaacggccgggatctgtagaagatctcgttgcgtacgggttcagganactagtattagcagcgacgtcggctcggtcgttggtcgcgaccgaggacgtcgggaccggggaaggccgtgggaggtggagtgggatacgatacgtaagttcgttaggtacgctacccgtaacgaaaccgtagtaacctacccgtaacccccgttcccgttaaccggaacgggtcccggtaccacccgtacgtccgtacgaccgtacccgacgtacgtacacgtcgtaacgttaaccgtaccgttacgtaggtaacggttacgtaacgtttacggaccgttaacgggggtaaccgggtcccgttaaccggaacccgtacccggtccgttaacgttacgtttaaacgtttaccgtaaggtacggtaacgttacgggttaacgggtaacggggtttacttacgtttaagttaaccggtcggggttaccgttcggttaacgtccggggtacgggaaccgggtaccgggtaaccccgttcgggtaaccccgttaacccgttccccg

SEQ ID NO: 305312 - DNA, 569 bp, Homo sapiens
  misc_feature: GZ8MTXP01CUZO7.10.5.A05.1.454.CMB.2.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (399)..(399): a, c, t, g, unknown or other
  misc_feature (399)..(399): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggatctgtgaagatctcttgcacgggttcaggagacagatttagcagcgactggctcggctggttgcgccagatggcccggggaaggcctgggagtggagtgggggatcatcaatcgttggtanctcctagaaaccngactaccaaccccgtccttccgaacggcccgggtaccaccatcctcgacgcccganacggtccagtcacgtactacctacttggagtgtattacgcctaggggaacggccgtcggaccaccgccgtatgttattactagtacgtagacgttaaggaacgggttattcgttagttagtggcgcgagtcggtggggccgacgggtacccgttggtccgcccgtccccg

SEQ ID NO: 305313 - DNA, 607 bp, Homo sapiens
  misc_feature: GZ8MTXP01EGWDK.10.5.A05.1.454.CMB.2.raw
  modified_base (347)..(347): a, c, t, g, unknown or other
  misc_feature (347)..(347): n is a, c, g, or t
tcagcatagtagtgcacgaccggtgctcgattttagatagatagacagggggtctccctcactgcccagctgggatctcagggcttcatttttctgtcctccactatcatggggtcaaccgccatcctcgccctcctcctggctgttctccaaggagtctgtgccgaggtgcagctggtgcagtcgggagcagaggtagaaaaaggcccgggagtctgtagaagatctcttgcgtacgggttcaggagacagtattagcagcgactggctcggctggtgcgcagatcggaccgggaagcgtggagtggagtggggatcgatcaattcgtggtagctcgtacgaaacngactaccaaccccgttcctcgacggccggtacacgactctacgacgaccgacacggtaccatcctaagttacctacttaacgtggacgttggattacgcgtagggaacggtccgtacggaccaccggtactataggttaacttacgtcgtaacgtacgtaccggttaagggtaaccgggttattaccttagttagtcggcgttcgttacgttcggacggggcctaaacggggtccttacgggtcccttaacccgtccccg

SEQ ID NO: 305314 - DNA, 868 bp, Homo sapiens
  misc_feature: GZ8MTXP01DZQ6V.10.5.A05.1.454.CMB.2.raw
  modified_base (249)..(249): a, c, t, g, unknown or other
  misc_feature (249)..(249): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcaggaggtagaaaaacggcccggggagtctgtagaagatctcttgcgtacgggttcagganacagtattagcagcgactggctcggctggtgcgcagagtcggaccggggaaggccgtagggacgtgggaaggtgggggactcgtaatacgtaaacgtttcgttaggtacgccttaccgtacggaaaaaccgagtaaccttaaccccgtaaaccccccggttaccgttaacccggaaaccggggtccccggggttaacccaaacccgtacgttacccgtaccggaacccgacccggtaaacgtaccgggtaacccgtaacttaaccgtaaacgggtttaaacccctttaccccggttaacggtttaacggggtaacggttacggtaaacgtttaaccggccccggtttaaacgggggaaacccgggtaccccggtttaaccccggggaaaccccgtaacccccgggttaacccctaaagtttacgggtttaaacctttaaccggttacgggttaaaacccggtacggttaaaccccgggtttaagggtaaacgggggttaacttttaccgttaaaggtttacgggtacgggttaccggttccgggttaacgttcccggggtacgggggaaccccgtaacgggggacccccgtttagggtccccgttaacccggtcccccg

SEQ ID NO: 305315 - DNA, 760 bp, Homo sapiens
  misc_feature: GZ8MTXP01BZ5ZP.10.5.A05.1.454.CMB.2.raw
  modified_base (261)..(261): a, c, t, g, unknown or other
  misc_feature (261)..(261): n is a, c, g, or t
tcagcatagtagtgcacgaccggtgctcgatttagatagatagacatggggtctccctcactgcccagctgggatctcagggcttcattttctgtcctccactatcatggggtcaaccgccatcctcgccctcctcctggctgttctccaaggagtctgtgccgaggtgcagctggtgcgaggtcgggagcgaggaggtaaggaaaaacggcccggggtatcgtggtagaagtcttctcgttgacgtacgggttcaggganactagtagtttacgcgtacggacgtacgtcggcgtcggtcgttgggtcgccggtccgaggacgtccggggacccgggggtaacgtccggtaggggacggtagggagggttaggggacttacgtaacgttacgttaacgttcggttaggtacgtccgttaccgtaacgaaacccgtacgtacccgtaaacccccgtccccgttaaccgttaccgaaccggggtcccggtacccaaccgtctacgtaccgaccgacgtaacggtacgtactactacgtaacggttcctaaccgttcggtaggtaggtacgtaacgtaccggtcggtaacgggaccggttcccgacggaccgtcccgtactacggttacttacgttacggtacggtaccggtacggttaaccggtaggggttaaccggtatttaagtcgttaagggttcgcggttacgtaacggtccgggtcgggaccggtaccggttacccggtcgttcccgtaaccccgg

SEQ ID NO: 305316 - DNA, 664 bp, Homo sapiens
  misc_feature: GZ8MTXP01EYJN5.10.5.A05.1.454.CMB.2.raw
tcagcatagtagtgcacgaccggtgctcgatttagatagatagacagggggtctccctcactgcccagctgggatctcagggcttcatttttctgtcctccactatcatggggtcaaccgccatcctcgccctcctcctggctgttctccaaggagtctgtgccgaggtgcagctggtgcaggtcgggagcaggaggtagaaaaagcccggggagtctgtagaagatctcgttgcgacggggttcaggagacagattagcagcgactggcgtcggcgtggtgcgccagagtcggacccgggggaagccgtgggaggtggagtgggggatccgatcaattcgttaggatcgtaccgtagaaaacagtactacccgaaaccccgttctcccgaaacgggtccgggtaccacctacgtctacgacgccgacgacggtaccactcgtaacgtaacctaccgttaacgtggtacggtagtagttacgccgtagggacggtccgtaccggaaccaccggacctagttcgttaacgttacgtagtaacgagtaaccgtaagggtaaccgggttatttacttaaagttacgtgggacccgttggttaacgtccgggttacggggcccggtaaaccgggtacccgttcggtaacccgttaaccccggtccccg

SEQ ID NO: 305317 - DNA, 724 bp, Homo sapiens
  misc_feature: GZ8MTXP01DQCVR.10.5.A05.1.454.CMB.2.raw
tcagcatagtagtgcacgaccggtgctcgatttagatagatagacagggggctacaacaggcaggcaggggcagcaagatggtgttgcagacccaggtcttcatttctctgttgctctggatctctggtcgcctacggggacatcgtggtcgacccagtctccagaactccgtggctgtgtctcgtggcgaggacggccaccatcagctgcgagtccagcagtagttgttctctacaacaagaaactagtaaacggtaattggttaacgcttacggtaccagacaacgaaaccaggacctagttacctaccgtaagccgtagtacttacgtaacgttttacggacgggtaccaacggtaccccgggacccggttaaacggtccccggggtacctacggacccgttagttccgaggtcggacgtacgggtcggggtacgtagggactaaggtaacttcgactcccacaacctagaccctaagcgtacccgagaccgaggtacctaaggaacgttacggtggtaaacggttaacttttaacggttttttactttaccgtacgtaaaccttaaaacgtttcgttaacttttccgtttttaccgtccggttaacccggttacggttccggtaacgtaaaccgggttacgggtaccggttaaaggacggtaacgttaaccttaacggttaacgtgtacggtcctcaacgttaccctgtttcggttaacc

SEQ ID NO: 305318 - DNA, 823 bp, Homo sapiens
  misc_feature: GZ8MTXP01EFW34.10.5.A05.1.454.CMB.2.raw
  modified_base (251)..(251): a, c, t, g, unknown or other
  misc_feature (251)..(251): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcggagcaggaggtagaaaacggcccggggatcgtgtagaagatctacttggcgtacgggttcaagganacgtagtagttagccgtagcgtactggctcgacgtggtgcgcagagtcggccggggaagcgtagggacggtaggagtggggtatccgtaagtaccgtaattccggtttagggtaccgtccgttacccgtaaaccggaaaaccgaacgtaaacccgttaacccccgtaacccccccggtttacccgttaaccccgggaaaccgggggtacccccgggtaacccgtaaaccccctaacgttcccgtacgggaaacccggaccgtaacccgtaaccggttaccaacgtaccgtaaacgtttaacccgttaacccggtttaacggttacgggaaggttacgggtaaacgtttaccgggtaacccggttacgggggtaaacccgggtacccggttaacccggggaaccctacccgggtaacctaggtttaacggttaacgttacgttacggtaacgtacggtaccgttaaggggtaaccggttattttaccgttaagttacgcgggttacgttccggttagtaaccgggtacggggaaccgtaccgggtacccgttcgttaacccgcccgttccccg

SEQ ID NO: 305319 - DNA, 790 bp, Homo sapiens
  misc_feature: GZ8MTXP01A171E.10.5.A05.1.454.CMB.2.raw
  modified_base (155)..(155): a, c, t, g, unknown or other
  misc_feature (155)..(155): n is a, c, g, or t
  modified_base (304)..(304): a, c, t, g, unknown or other
  misc_feature (304)..(304): n is a, c, g, or t
tcagcatagtagtgcacgaccggtgctcgatttagatagatagacagggggtctccctcactgcccagctgggatctcagggcttcatttttctgtcctccactatcatggggtcaaccgccatcctcgccctcctcctggctgttctccaaggngtctgtgccgaggtgcagctgggtgcgaggtcggggagcgaaggagggtaggaaaaacggcccggggagtcgtgtagaagtatcttcgttggacgtacgggttcaggtatacgagtattagcagcgacgtggcgtcggtcgttgggtcncggccgaggtacgtcgggcccggggaaggtccgtagggacggtggaggtggggatcgatcgaagttcgtaggacgtctaaccgaacgaaaccaggtaacctaccccgtaaccccgttccgtaaccgggaacgggtcccgggtaccaccctagttccgacgaaccggacccgtacgtacgggtacccagttacctaacggttaacccttaccgttaggttcgggtaagtcggtaacgttacgcccgtaagggggacccggtcccgtaaccggtaaccgtaccgtccccgtaagtttaccgttaacgtttacgtaacgggtaaccgtacggttaaccggtttaacgggtaaacggggttattttaccgttaaagtttacgggggacgttccggggttaacggttaccggtaaccgggggtaccgggggtaacccggtaaccccggggttaacccgttccggggtccccgttaacccccggtttccccg

SEQ ID NO: 305320 - DNA, 758 bp, Homo sapiens
  misc_feature: GZ8MTXP01EZB4S.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagcgtggtgcgaggtcgggagcgaaggaaggtaaggaaaaaacggcccgggggaagttcgtggtagaaagtattcttcgttggccgtacgggttcgaaggagacagtagttagcgtagcgacgtggcgtcggtcgttgggtcgccgaccgaggacgtccgggacccggggaaggtccggtaggggaggtgggaaggtgggggactacagtacgtaagttcgttaggtacgtctaccgtaacggaaacgtagtaccctaccccgtaacccccgttccgttaaccggaaacgggtcccggtaccaccgtatccgtacgacgacccgacgtacggtcctaactacgtaacgttaacccttaaccgttacgttagggaagttcggtaaacgttacgaccgttaacgggggaaccggttccccggtaccgggaaccctaaccggtaccctaagttacgttaacttaaccggtaggtaaaccggtacgtaacgggttaacgggtaacgggttattacgttacgtaggtacggcgttcgttacgttcgggccgggaaccgtaccggggtacccttcggtcccgaacccgtccccg

SEQ ID NO: 305321 - DNA, 553 bp, Homo sapiens
  misc_feature: GZ8MTXP01AO2TY.10.5.A05.1.454.CMB.2.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
  modified_base (517)..(517): a, c, t, g, unknown or other
  misc_feature (517)..(517): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccgggatctgtgaagatctcttgcacgggttcaggagacagtattgcagcgactgctcggctggtncgcagatcggcccgggagccgtggngtggagtgggatcgatcaattgttggtatctactagaacagactacccacccgtccttccgaagggtcccggtacacctactcgcacggcccganacggtccatcgagtacctacgtattgggaacttggaattcgaccgtaggggaacggcctacggaccaacccgcctagtactagtactgtacgagtacttggaacggttntttcgagttagngaccgttnacgttgaggggcctaggggacccnggtcncccgtcc

SEQ ID NO: 305322 - DNA, 519 bp, Homo sapiens
  misc_feature: GZ8MTXP02I9PRO.10.5.A05.1.454.CMB.2.raw
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctcgtgggcgagagggccaccatcagctgcaggtccagccagagtgttctcttcaacagaaacaataaggaatgttagcttggaccagcaagaaaccnggacagtctcctaagctgctntattacgngggcagtccgaaccggatccggggtcctgaccgntcgagtgcagcgggtcngggacagtaatcactcncaccatacaacagcctgccaggctagaaagntaggtggctagttttattctgtacaacgtagtacttcttcgtctccgtgacgttcgacgagggaccaagtcggaactacgaaacgacgtgtacggactcgacctacctagtctcg

SEQ ID NO: 305323 - DNA, 535 bp, Homo sapiens
  misc_feature: GZ8MTXP02H250C.10.5.A05.1.454.CMB.2.raw
  modified_base (377)..(377): a, c, t, g, unknown or other
  misc_feature (377)..(377): n is a, c, g, or t
  modified_base (499)..(499): a, c, t, g, unknown or other
  misc_feature (499)..(499): n is a, c, g, or t
tcagcatagtagtgcacgaccggtgctcgatttagatagatagacaggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaacagaaacaataaggaatgttagcttggtaccagcaagaaaccaggacagtctcctaaagctgctctatttactgggcagtcgaaccccgggaatccggggtccctgaccgattcagtgcagcgggtctgggacagaattcactcncaacatcaacagcctgcaaggctagaagatggtggtctaagtttttattactgtacaaatagtatttctttcttcgtccgtgtacgtttcggactaaaggggacctaaagggtacgtaaacncgtaaaacgaacgttgtcggactcgcaccattctag

SEQ ID NO: 305324 - DNA, 509 bp, Homo sapiens
  misc_feature: GZ8MTXP02HL09B.10.5.A05.1.454.CMB.2.raw
  modified_base (382)..(382): a, c, t, g, unknown or other
  misc_feature (382)..(382): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccataatccctggctgtgtctctgggcgagagggccaccatcagctgcaggtccagccagagtgttctcttcaacagaaacaataaggaatgttagcttggtaccagcaagaaaccaggacagtctcctaagctgctcatttactgggcatcgaccggaatccggggtcctgaccgattcagtggcagcgggtctgggacagaattcactctcaccatcaacngcctgcaggctagaagatgtggctagttttattcgtagtacaaactagtatctttcttctccgtgtacgttcggaccgaaggaccaaaggtcgaactacgaaaacgactgtcgctgcaccagtctcg

SEQ ID NO: 305325 - DNA, 553 bp, Homo sapiens
  misc_feature: GZ8MTXP02GRBD8.10.5.A05.1.454.CMB.2.raw
  modified_base (340)..(340): a, c, t, g, unknown or other
  misc_feature (340)..(340): n is a, c, g, or t
tcagcatagtagtgcacgaccggtgctcgatttagatagatagacaggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatggccccggggaaggcctggagtggagtggggatcgatcaatcttggagctctagaaaccngataccaccccgtcttccgaacggccggtcaccatctcacgccgacacggtccatcagtactacctactggagtgattagcctagaacggcctacggacaccgccagtgtattacgtgtacgagtacttaggaacggggtatttacgtattagtcggtacgcgacgtcggtcggggaccgacggggtaaccctcgggtaccacccggtccccg

SEQ ID NO: 305326 - DNA, 511 bp, Homo sapiens
  misc_feature: GZ8MTXP02ICMQ0.10.5.A05.1.454.CMB.2.raw
  modified_base (343)..(343): a, c, t, g, unknown or other
  misc_feature (343)..(343): n is a, c, g, or t
  modified_base (378)..(378): a, c, t, g, unknown or other
  misc_feature (378)..(378): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacaggatttagcaggcgactggctcggctggttgcgccagagtggcccggggaaggcctggagtggagtggggatcagtcaaatcttggagctctgaaaccngatacaccccgtcttccaaagggcggtcaccatcncacgccacaggtccatcagtactactacttgagtgattagctgaagctcggacacgcatgtattactgtacganacttgaacgggnttactatatgcgcgatccgtgggccacgggaaccctggtccacgtcc

SEQ ID NO: 305327 - DNA, 529 bp, Homo sapiens
  misc_feature: GZ8MTXP02IUKP1.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatggcccgggaggcctggagtggatggggatcatcaatcttggtagctctagaaccagactacaccccgtctccgaaggccggtcaccatctcagccgacaggtcatcagtactacctatggagtgattagcctgaacggcctcggacaccgcatgtattactgtacgagacttaggacggggtattcgtaattagtcggcgtacgatcgtcggggaccgtacgggaacccgtcggtaccgaccggtccc

SEQ ID NO: 305328 - DNA, 508 bp, Homo sapiens
  misc_feature: GZ8MTXP02IBWY5.10.5.A05.1.454.CMB.2.raw
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
tcagcatagtagtgcacgaccggtgctcgatttagatagatagacaggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatgcccggggaaggcctggagtggatggggatcatcaaatcttggtagctctgaaaccagatacaccccgtcttccaaggccggtcaccatctcagccacaggtccatcagtactacctacttggagtgattagcctgaagcctgacaccgccatgattacngtacgagacttgaacgggtntctattatcggcgngatcgtgggccacgggaaccctggacctacgccc

SEQ ID NO: 305329 - DNA, 521 bp, Homo sapiens
  misc_feature: GZ8MTXP02GKLFY.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggtgcgccagatgcccgggaaggcctggagtggatggggatcatcaatcttggtagctctgaaaccagatacaccccgtcttccaaggccggtcaccatctcagccgacacggtccatcagtactacctacttggatggattagcctgaaggcctcggacaccgccatgtattactgtacgagtacgttaggaacggggtattctattacgtggcgcgatcgtggggccagggaaccctggtcaccggtccc

SEQ ID NO: 305330 - DNA, 544 bp, Homo sapiens
  misc_feature: GZ8MTXP02H6HOV.10.5.A05.1.454.CMB.2.raw
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcagtccagccagagtgtctcttcaacagaaacaataaaggatgttaagcttggtaccagacagaaaccaggacagtctacctaagctgctcatttacngggcatcggacccggatccggggtcctcgaccgattcagtggcaggcggtctggacagaatcactcacacatcaacagcctgcagctagagangtgctagtttattctgtactaaacattatctttcttcgtaccgtggtaccgtttcgggaccctaaagggggaaccctaaaggggtacggtaaacctacgaaaaccggtaacgtggtacggcttacggacccaaccatttacccgtcg

SEQ ID NO: 305331 - DNA, 573 bp, Homo sapiens
  misc_feature: GZ8MTXP02JY4EG.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagattagcagcgactggctcggctggttgcgccagatggccccggggaaggccgtggagtggagtggggatcgatcaattcttggtagctctagaaaccagactaccaccccgtcttccgaacggccggtcaccatctcagccgacacggtccatcagtactaccgtacgttggacgtgtattacgccgttaggaacggccgtacgggacctacccgacctagtcgtaacttacgtagtacgtagacgttacggaacggggtattacgtattagtcggacgtcgagtcgtcggggaccgacggggtacccgtggtacccgaccgtcccg

SEQ ID NO: 305332 - DNA, 540 bp, Homo sapiens
  misc_feature: GZ8MTXP02IKIZH.10.5.A05.1.454.CMB.2.raw
  modified_base (334)..(334): a, c, t, g, unknown or other
  misc_feature (334)..(334): n is a, c, g, or t
  modified_base (382)..(382): a, c, t, g, unknown or other
  misc_feature (382)..(382): n is a, c, g, or t
tcagcatagtagtgcacgaccggtgctcgatttagatagatagacaggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggtgcgccagatgccggggagcctggagtggatggggatcgatcaatcttggtagctctagaaaccngataccaccccgttcttccgaaagggccggtcaccgatctcagccganacggtccatcagtactactactgagtgatagcctgagctcggacaccgcatgtattactgtacgagtacgttacggaaacggggtattactaagttagtcggacgtccgtattccggtgggggaccctacggggaaccctgggtacccacccggtccc

SEQ ID NO: 305333 - DNA, 491 bp, Homo sapiens
  misc_feature: GZ8MTXP02JN8N8.10.5.A05.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (470)..(470): a, c, t, g, unknown or other
  misc_feature (470)..(470): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagaggccaccatcagctgcaggtccagccagagtgttctcttcaacagaaacaataaggaatgttagcttggaccagcagaaaccnggacagtctcctaagctgctcatttacngggcatcgaccggatccggggtccngaccatcagtgcagcggtcngggacagaattcactctacacatcaacagcctgcaggctagaagatggtggctagtttattctgtacaactgtattcttctctcgtgacgttcgacgaggaccaggtcgaactacgaaacgacngtcgactcgaccacatcgtcg

SEQ ID NO: 305334 - DNA, 514 bp, Homo sapiens
  misc_feature: GZ8MTXP02FKSOQ.10.5.A05.1.454.CMB.2.raw
  modified_base (363)..(363): a, c, t, g, unknown or other
  misc_feature (363)..(363): n is a, c, g, or t
tcagcatagtagtgcacgaccggtgctcgatttagatagatagacaggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagccggggagtctgtgaagatctcttgcacgggttcaggagacagattagcagcgactggctcggctggttgcgccagatgcccggggaaggcctggagtggatggggatcgatcaaatctggtagctctgaaaccagatacaccccgtcttccaaggccggtnaccatctcagccgacaggtccatcagtactacctactggagtggattagcctgaacggcctcggacacgccatgtattactgtacgagacttgaacggggattctattactggcgctatcgtggggccacgggaccctggtccaccgtccc

SEQ ID NO: 305335 - DNA, 558 bp, Homo sapiens
  misc_feature: GZ8MTXP02JU0IR.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagattagcagcgactggctcggctggtgcgccagatggcccggggaaggcctggagtggagtggggatcgatcaaatcttggtagctctagaaaccagactacaccccgtcttccgaaggccggtcaccatctcacgccgacaggtccaatcagtactacctacttaggagtggaattacgccttaggaacgcctacggacaccgccatgtatactgtacgagtacgttaggaacggggtattactaagttacgtagggcgtacgatcggtacgggggccctaacggggaacccctgggtacccaaccggtcccc

SEQ ID NO: 305336 - DNA, 572 bp, Homo sapiens
  misc_feature: GZ8MTXP02G7VX1.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggtgcgccagatgcccggggaaggcctggagtggatggggatcatcaatcttggtagctctgaaaccagatacaccccgtcttccaaggccgggtcaccatctcacgccgacacggtccatcagtactacctactggatggattagcctagaacggtcctcgggacaccgccatcgtattactgtaacgagaccttaggaaaccgggggtatttacgtaattaagtcggtacgtccgtaagttccgttacgggggtacccgaacgggggtaaaccccgtcgggttacccgaacccggtcccccg

SEQ ID NO: 305337 - DNA, 578 bp, Homo sapiens
  misc_feature: GZ8MTXP02GNCCH.10.5.A05.1.454.CMB.2.raw
tcagcatagtagtgcacgaccggtgctcgatttagatagatagacaggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttacaacagaaacaataaaggaatgttagcttggtaccagcaagaaaccaggacagtctactaagctgctctatttactgggcagtccggaacccgggaatcccggggtcctcgaccgattcgaggtggccaggcgggtctgggacagtaactcactctacaccatacaaacacgcctagcaggctagaagatgtggacttagtttattctgtacaacgtagttacttctttcttcctcggttggtaaccgttcgggacccgtaaaggggtacccaaagggtacgtaaaccgttaccgaaaacggtaaacgtggttacgggaccttacggacctaaccgtattccgttacg

SEQ ID NO: 305338 - DNA, 737 bp, Homo sapiens
  misc_feature: GZ8MTXP02HT4WJ.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggtgcgccagatggcccggggaaggcctggagtggagtggggatcgagtcaatcgttggtagctacctagaaaccagaactaccacccccggttcttccgaaacggtcccgggtacacccgtatcctaccgacggcccgaacgtacggtaccaacgtcctaacggtttaaaccttaacccctttaacgttttacggggaacggttacgggtaagttttaaacggtcccccgttaagggtaaaaccggggtttccccgtaccgggggtaaacccctaaccccggtacccaaacggtttaagttaacgtttaacccgtagggttaaacccgggtaagtaaccggtttaacgggtaaaaccgggggttatttaccgttaaagtttacgtggggaccgtaccggtaagttcggttccgggggacccgtaaccgggggtaaccccgtttcggggtacccaaccccggttccccg

SEQ ID NO: 305339 - DNA, 678 bp, Homo sapiens
  misc_feature: GZ8MTXP02I2IIC.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggagtctgtgaagatctcttgtacgggttcaggagacagattagcagcgactggctcggctggttgcgccagatcggcccggggaaggccgtggagtggagtggggatcatcaatctggtagctctacgaaacagactacaccccgtcttaccgacgggccgggtacacccgtatcctacgacgacccgaacgacggtacccactacgaacggttaaccctaacccgttaaccgttttaggggaaaccggttggggaaacttttaacggacccgtttacgggaaacgggtaccccgttaccgggaaccacccgggaccctaagttacggttaaacttacgtacgtaacgtaacgtacgtttacggaaaccggggtatttacgtaacttagtacggcgtacgtaacgtcggttaacgggggaccgtaacggggtaaaccccgttcgggtacccaacccggtcccttacccg

SEQ ID NO: 305340 - DNA, 530 bp, Homo sapiens
  misc_feature: GZ8MTXP02IG4PX.10.5.A05.1.454.CMB.2.raw
  modified_base (212)..(212): a, c, t, g, unknown or other
  misc_feature (212)..(212): n is a, c, g, or t
  modified_base (466)..(466): a, c, t, g, unknown or other
  misc_feature (466)..(466): n is a, c, g, or t
  modified_base (496)..(496): a, c, t, g, unknown or other
  misc_feature (496)..(496): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggatcngtgaagatctcttgcacgggttcaggagacagatttagcagcgactggctcggctggtgcgccagatggcccggggaaggccgtggagtggatggggatcgatcaatctggtagctctagaaaccagactaccaccccgttccttccgaacggccggtaccaccactctacacgccgacacggtccatcacgtactacctactggagtagattacgctagacgcctcggacaccgccatgtattactgtaacgngtactaggacgggtattctatatcggcgtnagtcgcggggcacgggacctcggtacaccgtccc

SEQ ID NO: 305341 - DNA, 645 bp, Homo sapiens
  misc_feature: GZ8MTXP02IE80X.10.5.A05.1.454.CMB.2.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagaggccaccatcagctgcaggtccagccagagtgtctctcaanagaaacaataaggatgttanctaggaccagacagaaaccaggacagtctaccaagctgctactaatttaccggnggactacgtaccggaaccgggtacgtccccggggtacctacggaaccgtattacgaggttcggacgaacgggtccggggtacgtagggaaacctaagtaacttcaaccttcaccaaccaataccaaacgacgccctagacgacggtactaggaagtagtggtacgtacgttagttttattcgtacgactaaactacgttactttccgtttcttccgttaccgggtacggtaccggtttaccggaacccggtaaacggggtaaaccctaaagggttaacgtaaaccgtaaaccgaaaacggtacgtcggtacgtacgtacgaccgtaacctacgttcgtcg

SEQ ID NO: 305342 - DNA, 570 bp, Homo sapiens
  misc_feature: GZ8MTXP02G2SVA.10.5.A05.1.454.CMB.2.raw
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttacaacagaaaacaataaggaatgtttaagcttaggaccagacaagaaaccaggacagtctacctaagctgctctatttcnggcatcggacccgggaatcccggggtccncgaccgtattcgagtggcaggtcgggtctgggacagacttcactctcacatacaacacgccctagcaggctagaacgtatggtcggtacttaggttttattcgtaggtacctaaacgtagttacttctttctccgttacgtcgggtaccgttcggaccgtaagggaccgaagggttacgaaccgttaacgaaaccgtagttcggcgtaacgtacgaccactacgtcttacg

SEQ ID NO: 305343 - DNA, 631 bp, Homo sapiens
  misc_feature: GZ8MTXP02IVLZ1.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagccggggagtctgtgaagatctcttgcgacgggttcaggagacagtatttagcagcgactggctcggctggtgcgccagagtggcccggggaagccgtggagtggagtggggatcgatcaatcgttggtagctcctagaaaccagaactaccacccccgttccttccgaaacgggtcccgggtaccaccactcctacacgccgacacggtccaatcaacgtacctaccgttacgtggagtaggtattacgccgttggaacgtccgtacggaccacccgacctagttacgttaatacgttgtacgtagtacgtttacggaaacggggttactttacgtaagtttaacggtcgggtaccgtacggtacgttccggtacgggggacccgtaaaccgggggaacccgttcgggtacccgtaacccggtcccccg

SEQ ID NO: 305344 - DNA, 306 bp, Homo sapiens
  misc_feature: GZ8MTXP02GCSE2.10.5.A05.1.454.CMB.2.raw
  modified_base (306)..(306): a, c, t, g, unknown or other
  misc_feature (306)..(306): n is a, c, g, or t
tcagcatagtagtgcacgaccggtgctcgatttagatagatagacagggggaagaccgatgggcccttggtgaaggcctcggacaccgccatgtattactgtacgagacttgaacggggattctattatggcgcgatctggggccagggaaccctggtcaccgcctcctcagcctccaccaagggcccatcggtcttcccctggcaccctcctccaagagcacctctgggggcacagcggccctgggctgcctggtcaaggactacttcccactactatgctgagcgggctggcaaggcgcatagn

SEQ ID NO: 305345 - DNA, 580 bp, Homo sapiens
  misc_feature: GZ8MTXP02G9LR4.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggttgcgccagatggcccggggaagcctggagtggatggggatcgatcaatcgttggtagctcctagaaaccagactaccaccccgtcttccgaagggccggtcaccgatctcacgccgacacggtccagtcagtactacctacttggagtgattagctagaacggcctcggaccaccgccatgtattactgtacgagacgtttacggaacggggtattacgtaagttacgtacgggtccgtacgtaagttccggtcgggggacccgtaacgggggtaaaccccgtcgggttacccgaacccgggtccccg

SEQ ID NO: 305346 - DNA, 535 bp, Homo sapiens
  misc_feature: GZ8MTXP02JSCBX.10.5.A05.1.454.CMB.2.raw
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatggcccggggaaggcctggagtggagtggggatcatcaatcgttggtagctctagaaaccagactaccaccccgtcttccgaacgggccggtcaccatctcagcccgacacggtccatcagtactacctacgttggagtgatagcctagacggcctacggacaccgccatgtattactgtacgngacttggaacgggtnttcgtattagtcgcgngatcgtggggacctaggggaaccctggtaccaccgtcccg

SEQ ID NO: 305347 - DNA, 535 bp, Homo sapiens
  misc_feature: GZ8MTXP02IGGKP.10.5.A05.1.454.CMB.2.raw
  modified_base (333)..(333): a, c, t, g, unknown or other
  misc_feature (333)..(333): n is a, c, g, or t
  modified_base (396)..(396): a, c, t, g, unknown or other
  misc_feature (396)..(396): n is a, c, g, or t
  modified_base (479)..(479): a, c, t, g, unknown or other
  misc_feature (479)..(479): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttaagcagcgactggctcggctggttgcgccagagtggcccggggaaggccgtggagtggagtggggatcgatcaatcttggtanctctacgaaacagactaccaccccgtcttccgaacggccgggtacaccgatctacacgccganacgtcatcagtactactactagacgtgatagctagacgcgtcgacaccgctatgtatactgtacgagtacgtacgaacgggtnttacgtatagtcggacgtcgatcgtcgggacgtacgggaacctcggtcaccgtccg

SEQ ID NO: 305348 - DNA, 543 bp, Homo sapiens
  misc_feature: GZ8MTXP02GTC5D.10.5.A05.1.454.CMB.2.raw
  modified_base (188)..(188): a, c, t, g, unknown or other
  misc_feature (188)..(188): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggancagaggtgaaaagcccggggagtctgtgaagatctcttgcacgggttcaggagacagatttagcagcgactggctcggctggtgcgcagatggcccggggaagcctggagtggagtggggatcatcaaatcgttggagctcctagaaaccagactacaccccgtcttccgaacggccggtcaccatctcacgcgacacggtcatcagtactacctacttggacgtgatagcctagacggctcgacaccgcatgtatacgtgtacgagtacgtaggaacgggtattacgtagttacgtcggacgtcgtaagtcggtcggggaccgacggggtaaccctcggtaccgacccggtccc

SEQ ID NO: 305349 - DNA, 571 bp, Homo sapiens
  misc_feature: GZ8MTXP02F4SDB.10.5.A05.1.454.CMB.2.raw
  modified_base (449)..(449): a, c, t, g, unknown or other
  misc_feature (449)..(449): n is a, c, g, or t
  modified_base (492)..(492): a, c, t, g, unknown or other
  misc_feature (492)..(492): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagattagcagcgactggctcggctggttgcgccagatggccccggggaagccgtggagtggagtggggatcgatcaaatcttggagctctagaaaccagactaccacccccgttcttccaaagggcccgggtacaccatcctcacgccgacaggtcccatcagtactacctacgtgagtggattagcctagaacggcctcggacnccgaccatgtattacgtgaacgagtacgttaggaaacggggtnttactaagtttagcgggtacgacgtaagtccgtcgggggacctaacgggggaaccctttcggaacccgaccggttcccc

SEQ ID NO: 305350 - DNA, 557 bp, Homo sapiens
  misc_feature: GZ8MTXP02JE614.10.5.A05.1.454.CMB.2.raw
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagcatagtagtgcacgaccggtgctcgatttagatagatagacgagggggctacaacaggcaggcaggggcagcaagatggtgttgcagacccaggtcttcatttctctgttgctctggatctctggtgcctacggggacatcgtggtgacccagtctccagaatccctggctgtgtctcgtgggcagagggccaccatcagctgcaggtccagccagagtgttctcttcaacagaaacaataaggaattgttagcttaggaccagacaagaaacccaggacagtcctactaagctgcctacattttacgngggacagtccggacccgggtaatcccggggtcctggaacccgtnttcgaggtggccagggccgggtcaggggacagtaattcactctcacatcaacngccctgccaggctagaacngtgtggctagtttattcgtagtacactagttacttctttctcgtcgtaggccgttcggactaaggggacctaaagggtacgtaactacgaaaccgtagtggtacgacgtacgcacgtacttcgttacg

SEQ ID NO: 305351 - DNA, 561 bp, Homo sapiens
  misc_feature: GZ8MTXP02I9OBL.10.5.A05.1.454.CMB.2.raw
  modified_base (325)..(325): a, c, t, g, unknown or other
  misc_feature (325)..(325): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagattagcagcgactggctggctggttgcgccagatggcccgggaaggcctggagtggagtggggatcatcaagtcttgganctctagaaacctgactacaccccgtcttccgaaggccgggtcaccgatctcagtcccgactacggtccatcagtaacctaccctatggtagtagattagcctagaaggtcctacggacacccgcctagtgtacttaacgtgtaacgagtaccttaggaacggggtattcgtaattagtcggtacgcgtaagtcggtcggggaccgtaacgggaccttcggtaccaccggttccccg

SEQ ID NO: 305352 - DNA, 537 bp, Homo sapiens
  misc_feature: GZ8MTXP02JDLSQ.10.5.A05.1.454.CMB.2.raw
  modified_base (449)..(449): a, c, t, g, unknown or other
  misc_feature (449)..(449): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagattagcagcgactggctcggctggttgcgccagatggcccggggaagcctggagtggagtggggatcgatcaaatcttggtagctcctgaaaccagaactacaccccgtcttccaaaggccgggtcaccatctacagccgacaggtccatcagtactacctattgatggattagctgaacggctcggacacgccatgtatacngtaacgagacttggaacggggtattctaattagtcggcgacgtatcgtcggggaccaacggggaacccctgggtaccaaccggtcccc

SEQ ID NO: 305353 - DNA, 537 bp, Homo sapiens
  misc_feature: GZ8MTXP02GYFE4.10.5.A05.1.454.CMB.2.raw
  modified_base (343)..(343): a, c, t, g, unknown or other
  misc_feature (343)..(343): n is a, c, g, or t
  modified_base (463)..(463): a, c, t, g, unknown or other
  misc_feature (463)..(463): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggttgcgccagatggcccggggaaggccgtggagtggagtggggatcgatcaatcttggtagctctagaaaccngactaccaccccgtcttccgaaggccggtacaccgatctcacgccgacacggtccagtcaagtactacctacttggatgattagctagacgcctcggacaccgcatcgtatactgtacgngacttggaacggtattacgtattagtcgcgtcgatcggtcggggaccacggggaccctcggtaccaccgtcccg

SEQ ID NO: 305354 - DNA, 522 bp, Homo sapiens
  misc_feature: GZ8MTXP02GDPPY.10.5.A05.1.454.CMB.2.raw
tcagcatagtagtgcacgaccggtgctcgatttagatagatagacaggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatggcccgggaaggcctggagtggatggggatcatcaatctggtagctctagaaaccagactacaccccgtctccaaggccggtcaccatctcacgccgacacggtcatcagtactactactgagtgattagcctgacgctcggacaccgccatcgtattactgtacgagacttagaacggggtattcgtattagtcggcgcgagtcgtcggggacctacggggaaccctgggtccaccggtcc

SEQ ID NO: 305355 - DNA, 589 bp, Homo sapiens
  misc_feature: GZ8MTXP02G4Q9T.10.5.A05.1.454.CMB.2.raw
  modified_base (409)..(409): a, c, t, g, unknown or other
  misc_feature (409)..(409): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggagtctgtgaagatctcttgcacgggttcaggagacagtatttagcaggcgactggctcggctggttcgcgccagacgtcggaccccggggaaggccgtggaggtggagtggggatcgatcaagttcgttggtagtctacctagaaaccagactaccaccccgttacttccgacggccggtacaccatctcgacgccgacncggtaccagtcagtactacctacgttcggagtagtattacgcgttaggaacgtcctacggaccaccgcctatcgtattacgtgtacgtagtacgttacggaacgggtattacgttagttacgtcggacgtcgtagtcggtcggggaccgtacggaacccgtcggtacccaccggtccccg

SEQ ID NO: 305356 - DNA, 622 bp, Homo sapiens
  misc_feature: GZ8MTXP02GNHL7.10.5.A05.1.454.CMB.2.raw
  modified_base (329)..(329): a, c, t, g, unknown or other
  misc_feature (329)..(329): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcggagcagaggtagaaaagcccggggagtctgtgaagatctcttgcacgggttcaggagacagtatttagcagcgactggctcggctggttgcgccagatggcccggggaaggcctggagtggagtggggatcatcaatcttggtanctcctagaaaccagactaccaccccgttctccgaacgggccggccaccgactctccgacgccgacacggtccatcagtacctactacgttggagtggattacgccgtaggaacgtccgtacggaccacccggaccctagttacgttaacgtttaacgtagttaaccgtaagtaacccgtttaaggggaaacggggttactttaccgttaagtttaagtcgggaccgtcggtaacgttccggttacgggggaccgaaccgggggtaacccccgtcgaacccgtcccgttccccg

SEQ ID NO: 305357 - DNA, 506 bp, Homo sapiens
  misc_feature: GZ8MTXP02JAKTY.10.5.A05.1.454.CMB.2.raw
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
tcagcatagtagtgcacgaccggtgctcgatttagatagatagacagggggtctccctcactgcccagctgggatctcagggcttcattttctgtcctccactatcatggggtcaactgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggttgcgccagatgcccggggaagcctggagtggatggggatcatcaatctggtagcctctgaaaccagatacacccgtctccaagccggtcaccatccncagcanagcatcatactactagtgagtgatagctagacgcctcggaccaccgcatgtatatagtacgagtacgtagaagggtagttattattagtcgcgacgaagtcgtacgggacgacggaccgtacgtacgaccg

SEQ ID NO: 305358 - DNA, 700 bp, Homo sapiens
  misc_feature: GZ8MTXP02H7PAS.10.5.A05.1.454.CMB.2.raw
  modified_base (263)..(263): a, c, t, g, unknown or other
  misc_feature (263)..(263): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaaggcccggggatctgtgaagatctcttgcgacgggttcaggagacagtatttagcagcgacnggcgtcggctggtgcgccgagagtggcccggggaaggccgtaggagtggagtggggatacgagtacaaagtcgttaggtagtctaccgtacgaaaaccagtaactaccgtacccccgttccttacccgaaacgggtccggtaccaaccgaacttcctacgacgacccgtacgacggttaccaactacgtaacgtaaccttaacccgtacgtttagggaagttggtaacttacgaccgttaggaacggtaccgtacggaaccacccgacctaagttacgtaacgtttacgtacggtacgtaacgtaacgttacgggaaaccggggttatttaaccgttaacgttagttacgggaccgtacggtaacggttccgggttacgggggaccgaaacccgggggtaaccccgttacgggttaccccgaaacccggttcccccg

SEQ ID NO: 305359 - DNA, 555 bp, Homo sapiens
  misc_feature: GZ8MTXP02GHI05.10.5.A05.1.454.CMB.2.raw
  modified_base (495)..(495): a, c, t, g, unknown or other
  misc_feature (495)..(495): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagattagcagcgactggctcggctggtgcgccagatggcccgggaagccgtggagtggagtggggatcatcaatcgttggtagctccgtagaaaccagactaccacccccgttcttccgaacgggccggtcaccgactctcacgcgacaggtccagtcagtacctacctacgttggagtgattagccgtgacggtccgtacggacgaccgcctagttacgtattacgtgtacgagtacgttaggaacgggtnttcgtattactcggacgcgtatcggtcgggaccgtacgggacccgtggtccaccggtccc

SEQ ID NO: 305360 - DNA, 658 bp, Homo sapiens
  misc_feature: GZ8MTXP02IDTHU.10.5.A05.1.454.CMB.2.raw
  modified_base (231)..(231): a, c, t, g, unknown or other
  misc_feature (231)..(231): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcgaggaggtagaaaaacggcccggggatctgtagaagatctnttgcgacgggttcaggagacagtatttagcagcgactggctcggctggttgccgccagagtcggacccggggaaggccgtggaggtggagtggggatcgatcaattcgttggtagtctcgtacgaaccagtactaccgtaccccgttccttaccgacgggtccggtaccacctacctctacgaccgacccgacgacggtaccagtacacgttaacctaccgttacgttaggagttagtacttacgtaccgtaggaacggtccgtaccggacgacccgacctagttacgttacgttaacgttcggtaacgtacgtaacggtttacggggaaacggggttatttacgttaagttaggtcgggtacgtacggtacgttccgggtacggggaccgaacggggtaacccgtcggtaccgtacccggtccccg

SEQ ID NO: 305361 - DNA, 557 bp, Homo sapiens
  misc_feature: GZ8MTXP02JO1SE.10.5.A05.1.454.CMB.2.raw
  modified_base (385)..(385): a, c, t, g, unknown or other
  misc_feature (385)..(385): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggatctgtgaagatctcttgcacgggttcaggagacagatttagcagcgactggctggctggtgcgccagatcggcccggggaagcctggagtggagtggggatcatcaatctggtacgctctagaaaccagactaccaccccgttcttccgaacggccggtcaccatctcacgccganacggtccatcaacgtacctaccgtagttggagtagattacgctagacgtcctacggacaccgcatagtactatcgtacgagtacgttaggaacgggttattacgtagttacgtcggacgtcgagtcggtacggggaccgtacggggtacccgttcggacccaccggtccccg

SEQ ID NO: 305362 - DNA, 744 bp, Homo sapiens
  misc_feature: GZ8MTXP02IOUZS.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggatctgtgaagatatcttgcacgggttcaggagacagtatttagcagcgactggctcggctggttgcgccagacgtcggcccggggaagccgtggacgtggagtggggatacgatcaatcgttggtagctctacgaaaccagactaccgacccccgttcttccgaaacgggtcccgggtaccaccactcgtacgacgacccgacgacggttccaactccgtaacgttaaccttacccgttaacgttaggggaacggttacgggtaatttacggacccgttagggaaaaccggggttcccgttacccggggaaccaacccccgggtaccctaaagttaccggtttaaacgtttaaccggttacggttaaaaccgggtaacgttaaccgttttaaacggggaaaacccgggggtttattttaaccgtttaaagtttaacggtcggggtaccggtacggtaaacgtttccgggtacgggggtacccgtaaaacgggggtaaaccccgttcggggttacccgaaccccggttaacccccg

SEQ ID NO: 305363 - DNA, 652 bp, Homo sapiens
  misc_feature: GZ8MTXP02HDLOU.10.5.A05.1.454.CMB.2.raw
  modified_base (188)..(188): a, c, t, g, unknown or other
  misc_feature (188)..(188): n is a, c, g, or t
  modified_base (578)..(578): a, c, t, g, unknown or other
  misc_feature (578)..(578): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggancagaggtgaaaaagcccggggatctgtgaagatctcttgcacgggttcaggagacagtatttagcagcgactggctcggctggtgcgccagactggacccggggaaggccgtaggagtggagtggggatcgaatcaaatccgttaggtagtctaccgtacgaaaacctagaactaccgacccccgttccttcccgaaacgggtcccgggttaccaacccgattcccacgaaccgcccgaccgacggtccaactccgaacgttaccgtaccgttaccgttagggaacgttagggtactttaaacggcccgttaaggaaaccggtccctacgggaccacccggacctatacgttacttacgtagtaacgagtaacgttacggaaacgggttnttacgtagtttacgcgggtacgcgtacgtcggtacggggaccgacgggtaaccctcggtacccgacccgtcccg

SEQ ID NO: 305364 - DNA, 733 bp, Homo sapiens
  misc_feature: GZ8MTXP02JR9E5.10.5.A05.1.454.CMB.2.raw
  modified_base (153)..(153): a, c, t, g, unknown or other
  misc_feature (153)..(153): n is a, c, g, or t
tcagcatagtagtgcacgaccggtgctcgatttagatagatagacaggggtctccctcactgcccagctgggatctcagggcttcattttctgtcctccactatcatggggtcaaccgccatcctcgccctcctcctggctgttctccaaggngtctgtgccgaggtgcagctggtgcaggtcgggagcaggaggtagaaaacggcccggggagtcgtgtagaagtatcttcgttgacgtacgggttcaaggagacgtagtagtttagcagccgtacgtcggcgtcgggcgtggttcgccgccgaggtacgtcggggaccccggggaaggtccgtaggggaggtaggaggtagggggactacgtacgttacgtaacgttcggtttaggtacgtaccttacccgtaacgaaaaccgacgtaacctacccccgtacccccggttaccttacccgggaaacgggtcccggtaaccacccgtacgtccgtaccgaccggacccgtacgtaccggtacctacgtacgtaacgttacctacccttagttacggtagtacgtaattcggaccgtacggacggccgtacgaccgacccgactacgttacgttacgttacgtacggttacgtaacgtacggtttacgggaaacggttcttacgttagttacggtcggaccgtacgtacggtccgggtacgggaccggtaccgggtaccgtcggttacccgacccgttccccg

SEQ ID NO: 305365 - DNA, 556 bp, Homo sapiens
  misc_feature: GZ8MTXP02IXY8U.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagtatttagcagcgactggctcggctggttgcgccagactcggcccggggaaaggccgtggagtggagtggggactcgatcaattcgttaggtagctctagaaaccagactacacccccgttctccgaacggcccggtacaccgtatctacgagacccgacacggtcccatacagtactacctattggagtgattacgctagacgcgtcgacaccgcagtgattacgtgtacgagtacgttacggacgggtattctaagttcgtggacgtcgatcggtcgggacctacggggaaccctcggacctaccggccc

SEQ ID NO: 305366 - DNA, 720 bp, Homo sapiens
  misc_feature: GZ8MTXP02IEC7Y.10.5.A05.1.454.CMB.2.raw
  modified_base (400)..(400): a, c, t, g, unknown or other
  misc_feature (400)..(400): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtcgacccagtctccagaactccctggctgtgtctcgtgggcgagacggccaccatcagctgcaggtccagccagtagtgttctctacaacaagaaacaataaggtaatgtttacgcttaggaccagacaacgaccaggacagtactacctaagctacgtctactacgtttacggcgggacctacggtacccgggaacccggggtaacgtcccggggtaccctcggaacccgtagtttcgacggtcggaccgnggggtccggggtacgggtacggtaaaccagggtaaccttccaccttaccctacaaccctaactaccaaaccgcggtacccgtaggcccgaaggaccgttagaaacgttagttagggtcgttacgttacgttttattacccgtcggttaaaccactttacgttactttcctttacgttaccgttccgggttacggtaacccggtttaccggggaaccgtaaacggggtacccgtaaaagggtacccggtaaaacgtaacccgaaaacgtaaccgttggaaccgggtccttacggtaacccgaccgttaactacgtttaccg

SEQ ID NO: 305367 - DNA, 567 bp, Homo sapiens
  misc_feature: GZ8MTXP02GGLM4.10.5.A05.1.454.CMB.2.raw
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
  modified_base (452)..(452): a, c, t, g, unknown or other
  misc_feature (452)..(452): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctnttgcacgggttcaggagacagtatttagcagcgactggctcggctggtgcgccagagtcggccggggaagccgtggagtggagtggggatcatcaatcgttggtanctactagaaaccagactaccaccccgtcttccgaaggcccgggtacacctatctcacgcccgacacggtcagtcagtactacctactaggagtgattagcctagaacgcctcggacgaccnccatagtattactaggacgtagtactaggtaacggggatttcgtaattaagtcggacgtcgtaagtccggtacggggaccgtacgggaacccgtcggtaccgaccccgtcccccg

SEQ ID NO: 305368 - DNA, 700 bp, Homo sapiens
  misc_feature: GZ8MTXP02IFQFZ.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagccggggatctgtgaagatctcttgtacgggttcaggagacagtatttagcagcgatggctcggctgggttgcgccgagagtcggccccggggaagccgtggagtggagtggggatcgatacaagtcgttggtacgctctacgaaaacccaggtaactaccgtacccccgttcctttacccgaacggggtccccgggttacaacccgtacttccgtcgaacgacccgacgtacggtacccaactaccgtaacgttacccttaaccgttaccgtttagggtaacgtacgggtacttacggacccgtttaagggaaaccgggtcccgttaccggggaaccctaaccggacccgtaagttacgttaactttacgtacgttaacggagtaacgttaggtaaaaccggggttatttaccgtaatttaacggcggtacgtacgttagtccggtcgggggtacccgtaacggggtacccgtacgggtaccctaaccggtccctcccg

SEQ ID NO: 305369 - DNA, 555 bp, Homo sapiens
  misc_feature: GZ8MTXP02HIAXN.10.5.A05.1.454.CMB.2.raw
  modified_base (493)..(493): a, c, t, g, unknown or other
  misc_feature (493)..(493): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggtgcgccagatggcccggggaaggcctggagtggagtggggatcgatcaaatcgttggtagctccgtagaaaccagactaccacccccgttcttccgaaagggccgggtacaccgactctcgacgcccgacgacggtccatcaagtactacctattggacgtgattagctgaacgcctcggacaccgccatgtacttacagtacgagtacgttagaacgggtnttactagttacgtggcgcgatcgtcggggaccgacgggaacccgtcggtaccacccggtccc

SEQ ID NO: 305370 - DNA, 569 bp, Homo sapiens
  misc_feature: GZ8MTXP02JUHQP.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggtgcgcagatggcccggggaaggcctggagtggagtggggatcatcaattcgttggtagctccgtagaaaccagactaccaccccgtcttccgaacgggccggtcaccatctcacgccgacgacggtccagtcagtactacctactggacgtgattagctagacggtctcggacaccgcagtgtatactgtacgagacgttacggaacggggtatttacgtagttaacgtcgggccgtacgtacgttcggtcgggggtacccgaacggggtaacccctcgggtacccgacccgtccccg

SEQ ID NO: 305371 - DNA, 759 bp, Homo sapiens
  misc_feature: GZ8MTXP02GTOGF.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaggcccggggagtctgtgaagatctcttgcgtacgggttcaggagacagtattagcagcgactggctcggctggttgcgcagagtggcccggggaggccgtggagtggagtggggatcgatactaaagtcgttggtagctcgtagaaaccagactaccacccccgttcttccgaacgggtcccggtacaccgtactcctacgacgaccgaccgacggtcccaagtccgtaaacggttaacccttaacccgtttaacgtttacggggtaacgggttacggtaacgtttaaccggacccgtttaacggggaaaccgggtaccccggttaaccgggtaaaccccggaaccccgtacccgttaaagttacggttaaactttaaccggtacggttaaacgggtaacgttaaaaccggtttacggggtaaaaccgggggttattttaacccggttaaggtttaacgtaccgggtaccggtacggtaaacgttccggggtacgggggtaaccccgtaaacgggggtaaacccccgttcggggttaccccgaaccccggttcccccg

SEQ ID NO: 305372 - DNA, 657 bp, Homo sapiens
  misc_feature: GZ8MTXP02HPPO5.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggatctgtgaagatctcttgcacgggttcaggagacagatttagcagcgactggctcggctggtgcgccagagtcggcccggggaaggccgtggagtggagtggggatcgatcaatcgttggtagctacctagaaaccagactaccgtacccccgtcttcccgaaacgggtcccggtaccaccgtacttcgacgacgacccgacacggtccagtcaacgtacctacctacgttggagtagtattacgccgtaggaaacggccgtacgggaaccgtacccggacctacgttacgttactttacgtacggtacgtaacgtaacgtttacggaaaaccgggggtttatttaccgttaagtttaacggtcgggtaccgtacggtaacgttccggtacgggggacccgtaccgggggtaaaccccgtttcgggtacccgtaaccccggttcccccg

SEQ ID NO: 305373 - DNA, 628 bp, Homo sapiens
  misc_feature: GZ8MTXP02F1MO2.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggatctgtgaagatctcttgcgacgggttcaggagacagtattagcagcgactggctcggctggtgcgcagatggcccgggaggccgtggagtggagtggggatcgatcgaaattcgttggtacgtctacctagaaaaccgagaactacccacccccgttccttaccgaacgggtcccggtacacccattccgtcgacgccgacgtacggtaccagtctacgttacctaccgttacgttcgggagtagtattacggtcctaggacggccgtacggaccaccgacctagttacgttacttacgtagtacgaacgtacgttaacgggtaacggggttattacggttacttaggtcgggcgtacgtacgttccggtacgggggtacccgacggggtacccgtcggtacccgacccggttccccg

SEQ ID NO: 305374 - DNA, 569 bp, Homo sapiens
  misc_feature: GZ8MTXP02FLV82.10.5.A05.1.454.CMB.2.raw
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctcgtggggcgagacgggccaccatcagctgcaggtccagccagagtgttctcttacaacagaaacaataaggaattgttagcgttggaccagacaagaaaccaggacagtctactaagctagctntatttacgngggacagtccggacccggggatccccggggtccacggacctatcgaggtcggacaggcgggtcnggggacagtacttcactcacacatacaacncgcctgcaggctagaagngtggtgacttagtttnttacgtgtaccaacgtagttacttctttcttacgtcggttacggtaccgttacggaccgaagggtaccgtaagggtacgtaaaccgaacgtaacgtacgtggtcgacgtacgacaacctctactttcg

SEQ ID NO: 305375 - DNA, 815 bp, Homo sapiens
  misc_feature: GZ8MTXP02H13JY.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcggagcagaggtagaaaaacggccggggagtctgtagaagatctcttgcgacgggttcgaggagacagtatttagcagcgactggctcggttggttgcgccagagtcggcccggggaaggccgtggagtggagtggggatcgatcgaatcgttaggtagctcgtacgaaaccagtactacccgtacccccgttccgttaccgacgggtcccgggttacaacccgtactccctacgacgtacccggaaccgtacggtacccaacgttaccgtaacgttaaaccccgtttaacccttaaccggtttagggaaacggtttacggggtaactttaacgggacccccggtttaagggaaaccggggtacccccgtttaacccgggggaaaccccaaccccggggtacccctaagtttaacggtttaaccgttttaaacccggttacgggttaaacccggtaacggtttaacccggttaaacgggggttaaaaccgggggtttaactttttaaccgggttaaacttttaaacgggtccgggttacggaccggttaaacgttcccgggggttaacggggacccggtaaacgggggtaacccccgtggggtacccccaacccgggtccccttacccccgg

SEQ ID NO: 305376 - DNA, 538 bp, Homo sapiens
  misc_feature: GZ8MTXP02IPKZQ.10.5.A05.1.454.CMB.2.raw
  modified_base (330)..(330): a, c, t, g, unknown or other
  misc_feature (330)..(330): n is a, c, g, or t
  modified_base (464)..(464): a, c, t, g, unknown or other
  misc_feature (464)..(464): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggatctgtgaagatctcttgcacgggttcaggagacagtatttagcagcgactggctcggctggttgcgccagatggacccggggaaggccgtggagtggagtggggatcgatcatcttggtanctctagaaccagactaccaccccgttctccgaaggcccggtacaccatctcacgccgacacggtccatcagtactaccttacttggagtgattagctgaaggtcctacggacaccgcatgtattactgtaacgngtacttcggaacgggtattacgtattacgtcggcgcgtactcgtcgggactacgggacctcggtccaccgtccc

SEQ ID NO: 305377 - DNA, 586 bp, Homo sapiens
  misc_feature: GZ8MTXP02IDHOE.10.5.A05.1.454.CMB.2.raw
  modified_base (365)..(365): a, c, t, g, unknown or other
  misc_feature (365)..(365): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctctcctggctgttctccaaggagtctgtgccgaggtgcagctggtgcaggtcggagcaggaggtagaaaaaggcccggggaatctggtagaagatctcgttgcgacgggttcaggagacagtatttagcagtcgactggctcggctggttcgcgccaagacgtcggacccggggaagccgtaggaggtggagtaggggatacgatacaagtcgtggtaacgctccgtagaaacngaactaccgacccgtcttccgaacgggtccgacaaccgatcacaacgccaacacggtaccagttacaacgttactacgtacgttaggagtgtaattacgcctagaacgtcgacggaccaacgcctagtacgttatactagtacgagtacgttaggaacggttatcgtaatacgtgaccgatacgtcgcggggacctacggaaccctcgggtaccaccgccc

SEQ ID NO: 305378 - DNA, 595 bp, Homo sapiens
  misc_feature: GZ8MTXP02IDEKI.10.5.A05.1.454.CMB.2.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (305)..(305): a, c, t, g, unknown or other
  misc_feature (305)..(305): n is a, c, g, or t
  modified_base (424)..(424): a, c, t, g, unknown or other
  misc_feature (424)..(424): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtgacccagtctccagaatccctggctgtgtctcgtgggcgaggacgggccaccatcagctgcaggtccagccagngttgtctcttacaacagaaacanaaagtaagtattagtactcgtacgacagacgaacgaaacgagatctacctactagctntctattacttggcgactacgaccggaccggtaccggtcccggtaccacgactctacggtggcggtacgcgggtcgtagggactaagtaacttcacctctaccgaaccactacaaacgcncccgtacgcgacgagtagaacgtagtggttcggacttattttagtttccagtactaatagttctttctttacgtcctcgggtcgtaacggttcccggaacgtaaacggggacgtaaaggtacggtaaacacgaaaccgtaagttggcgactcggaccaccctatttctccg

SEQ ID NO: 305379 - DNA, 639 bp, Homo sapiens
  misc_feature: GZ8MTXP02FZCXQ.10.5.A05.1.454.CMB.2.raw
  modified_base (329)..(329): a, c, t, g, unknown or other
  misc_feature (329)..(329): n is a, c, g, or t
  modified_base (370)..(370): a, c, t, g, unknown or other
  misc_feature (370)..(370): n is a, c, g, or t
  modified_base (456)..(456): a, c, t, g, unknown or other
  misc_feature (456)..(456): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcggtggtcgaccccagtcctccagaactcccgtggctgtgtctcgtgggcgaggacggcccaccatcagctgcgaggtccagccagtagttcgttctcttacaaacaagaaacaagtaaggaattgttagcgttaggtaccagacaacgaaaccaggacagtctaccaagctgtctatattacgngggcacgtccggacccggtagtcccggggtcctcgaccgtntcgagtggcgacgggcgggtcgtacgggacagtaacttcactcctaccactactaccaaacgcgccctgccgaggactagaaacgngttaggtggtacttagttttaacttcgttacgtaactaacgtatttacttcttttaccgtccgttaccggtacgggtacccgttaccgggaacggaaacgggtaccgtaaaggggtaacgtaaaccgtaaaccgtaaacggtaacgtcggttacgacgtaccgaccacgtacgttactttccg

SEQ ID NO: 305380 - DNA, 607 bp, Homo sapiens
  misc_feature: GZ8MTXP02HAPMJ.10.5.A05.1.454.CMB.2.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtgacccagtctccagaactccctggctgtgtctcgtgggcgaggaggccacatcagctgcaggtccagccagagtgttctcttacaacaagaaacaataaggaatgttagcttaggtaccagacaagaaaccaggacagtcctacctaagctgctctattacgngggcagtccggaaccgggtacgtcccggggtccncggacctatcgaggtgcgaggcgggtctgggacagacttcactcacacatacaacgacncctgacaggctagaagtgtggtggtacttagttttattccgtagtacctaaacgttagttactttcctttacgttccgtaccggttacgggtacccggtttacggacccgtaaacggggaacccgtaaaggggttaacgaaccgttaacgaaaacggtacgtaacggttacggacctacgacctaacctacgtttcgtacg

SEQ ID NO: 305381 - DNA, 674 bp, Homo sapiens
  misc_feature: GZ8MTXP02HKUNN.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggagtctgtgaagatctcttgcacgggttcaggagacagattagcagcgactggctcggctggtgcgccagagtcggcccggggaaggccgtggagtggagtggggatcatcaaatcgttaggtagctccgtacgaaaccagtactaccgacccccgttcttcccgaacgggtccgggtaccaccgacttccgtacgacgacccgacgacggtcccaagtactaacgtacctaaccgttacgttgggaaggttaggacgtttaacgccgttaggaaaccgggtccgtaccgggaacccacccggtaccctaagttacggttaactttacgtacggtaacgtaaggtaaccgtttaagggaaacgggggttatttacgtaagtttaaggtcgggtacgtcggtaacgttcgggttacgggggaacccgacgggggtaacccgttcgggtaccgtaccccggtccccg

SEQ ID NO: 305382 - DNA, 544 bp, Homo sapiens
  misc_feature: GZ8MTXP02GHU7E.10.5.A05.1.454.CMB.2.raw
  modified_base (502)..(502): a, c, t, g, unknown or other
  misc_feature (502)..(502): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggactctgtgaagatctcttgcacgggttcaggagacagatttagcagcgactggctcggctggttgccgccagagtggccccggggaaggccctggagtggagtggggatcgatcaatcgttggtagctcgtagaaaccagactaccacccccgttccttccgaacggccggtcaccatctcacgccgacacggtccatcagtactacctactgagtgattagctgacgcctacggacaccgccatgtatacgtgtacgagtacttaggacgggtattacgtattacgtcggcgngtacgtcgtcgggccgacgggaccctcggtaccaccgtcccg

SEQ ID NO: 305383 - DNA, 568 bp, Homo sapiens
  misc_feature: GZ8MTXP02HSE52.10.5.A05.1.454.CMB.2.raw
  modified_base (401)..(401): a, c, t, g, unknown or other
  misc_feature (401)..(401): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcgagaggtagaaaaaggcccggggagtctgtagaagatctcttgcgacgggttcaggagacagatttagcagcgactggctcggctggtgcgcagagtcggccggggaaggccgtggagtggagtggggatcatacaatcgttaggatctacctagaaacctagactacccgacccccgttaccttccgaaacgggccggtaccacctatcncacgaccgacacggtcactcgagtactacctagtgaagtgattagcctagaacgccacggacaccgcatgtatactagtacgagtacgtaggaacgggtattacgtattagcggacgcgtaacgttcggacgggaccgaacgggaccctacggtacccaccgtcccg

SEQ ID NO: 305384 - DNA, 720 bp, Homo sapiens
  misc_feature: GZ8MTXP02GZ53R.10.5.A05.1.454.CMB.2.raw
  modified_base (314)..(314): a, c, t, g, unknown or other
  misc_feature (314)..(314): n is a, c, g, or t
  modified_base (458)..(458): a, c, t, g, unknown or other
  misc_feature (458)..(458): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcggtggtcgacccagtctccagaatccctggctgtgtctcgtgggcgagaggccacatcagctgcaggtccagccagagtgttctctacaacagaaaacaataaggaatgttagcttaggtaccagacaagaaaccaggacagtcctacctaagctgactctactttacgngggacacgtccggaaccccggggtaagtccccgggggtccctacggacccgtattccgaggttcggccgagggtccgggggtactacgggggaacctaaggtaactttcaaccgttcctacccaaccctacttacccaaaacgnggtacccttaggacccgtaacgggaccttaagggaaaacgtacgttagggttacggtaccgtttaaagtttttacgtttcgttaacggttaacctaaaacgttacggtttaacttttccttttaccggttccgttaccggttcggggttaacccggtttaccggaacccggtaaaacgggtacccgtaaagggtacgtaaaaccgttaaccgaaaacggtacgtaacggtacggaccttacgaccctacctacgttacttcg

SEQ ID NO: 305385 - DNA, 580 bp, Homo sapiens
  misc_feature: GZ8MTXP02G1U2L.10.5.A05.1.454.CMB.2.raw
  modified_base (332)..(332): a, c, t, g, unknown or other
  misc_feature (332)..(332): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtgaaaagcccggggatctgtgaagatctcttgcacgggttcaggagacagtattagcagcgactggctcggctggttgcgccagagtcggacccggggaagccgtggagtggagtggggatcgatcaatcgttgganctctagaaaccagactaccaccccgttcttccgaacggccggtacaccgtatcgtcacgcccgacgacggtccatcaacgtactaccgtacgttggagtaggattacgcctaggaacggcctacgggaccaccgctagtgtaattacgtgtacgagtacgttacggaacggggtattcgtaagttacgtcgggacgtacgtagtcggtacggggaccgtaacggggaaccctcggtaccaccgtcccg

SEQ ID NO: 305386 - DNA, 555 bp, Homo sapiens
  misc_feature: GZ8MTXP02FICB8.10.5.A05.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcagaggccaccatcagctgcaggtccagccagagtgttctcttcaacagaaacaataaggaatgttagcttggtaccagcaagaaaccaggacagtctctaagctgctcatttacgngggcagtccgacccgggaatccccggggtcctcgaccgattcgaggtgcagggccgggtcngggacagtaacttcgactctcaccatacaacacgcctgcaggctgaagagtggnggcttagttttattctagtacaaactagttattccttttctccgttccgtgggtacccgttcggacccgaaaggggaaccctaagggtacgtaactaccgaaaacgtacgtgtggtcctacgaccaacctatcttacg

SEQ ID NO: 305387 - DNA, 617 bp, Homo sapiens
  misc_feature: GZ8MTXP02HHINC.10.5.A05.1.454.CMB.2.raw
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
  modified_base (452)..(452): a, c, t, g, unknown or other
  misc_feature (452)..(452): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagacgggccaccatcagctgcaggtccagccagagtgttctcttacaacagaaacaataaggattgttagcttggtaccagacaacgaaaccnggtacagtcctacctaagctgtactcctatttacgngggcagtcccgggaacccgggtacgtcccggggtccctaggacccgtattcgaggtcggacgacgggtcggggtacgtaggggaactaaggtaacttccgaacttccaaccacgtactaccaaacgcgtcccgngacgaggctagagtgtgtagttactttagttttacgtcgtagtaactacgttagtttctttcgtttcgttacggttccgggttacggtaccggtacggaacggtaacggtaaaccgtagggtaacgaaacctacgaaacgtgtcgtgctacgactacgtctcgtc

SEQ ID NO: 305388 - DNA, 649 bp, Homo sapiens
  misc_feature: GZ8MTXP02I016A.10.5.A05.1.454.CMB.2.raw
  modified_base (351)..(351): a, c, t, g, unknown or other
  misc_feature (351)..(351): n is a, c, g, or t
  modified_base (392)..(392): a, c, t, g, unknown or other
  misc_feature (392)..(392): n is a, c, g, or t
  modified_base (406)..(406): a, c, t, g, unknown or other
  misc_feature (406)..(406): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaaggcccggggatctgtagaagatctcttgcgacgggttcaggagacagtattagcagcgactggctcggctggtgcgccagagtcggacccggggaaggccgtggagtggagtggggatcgatcaatcgttggagctactacgaaaccngactaccgacccccgttctccgacggccggtcaccgtatcncacgccagcgtcanctagtacctactacgttggagtagtattacgccgttaggaacggtcccgtaccgggaccgtaacccgtcctaagttcgttaactttacgttaggtaaccggtaacggttaccgtttaacggggaaaccgggggttatttaccgttaaaggttaacgtcggggtacgtaccggtaagtccggggttacgggggacccgtaccgggggtaaccccgtttcgggtaccccgtaacccggttccccg

SEQ ID NO: 305389 - DNA, 532 bp, Homo sapiens
  misc_feature: GZ8MTXP02FMJ9F.10.5.A05.1.454.CMB.2.raw
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctctgggcgagagggccaccatcagctgcaggtccagccagagtgttctcttcaacagaaacaataaggaatgttagcttggtaccagcagaaaccaggacagtctcctaagctgctctatttacngggcagtccggaccccgggaatcccggggtccctgaccgattcagtggcagcggggtctggggacagaattcactctcaccatacaacagcctgcaggctagaagntggtggactagtttatttctagtacaactagttactcttttctcctccgtggacgttcggaccgaacgggaccaagggtacgaactacgaacgtaacgtgtacggctcgactaccactctcg

SEQ ID NO: 305390 - DNA, 644 bp, Homo sapiens
  misc_feature: GZ8MTXP02GW8F4.10.5.A05.1.454.CMB.2.raw
  modified_base (273)..(273): a, c, t, g, unknown or other
  misc_feature (273)..(273): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaaggcccggggagtctgtgaagatctcttgcacgggttcaggagacagtatttagcagcgacgtggctcggntggtgcgccagagtcggcccgggaagccgtggagtggagtggggatcgatctaattcgttaggtacgtctaccgtacgaaaaccagtaacctaccgtaccccccggttccttaccggaacggggtccccgggttaccaaccctacgtctaccgacgacccgaacgacggtccatacgaacgttacctacccgtacgttggacgttaggtacgttacgccgttaggaacggtccgtacggaccacccgacctatacgtattacgtgtacgagtacgttacggacgggtattacgtagttacgtcggacgtacggtagtcggtacgggggacccgtaacggggtaacccgtcgggtccctaacccggtccccg

SEQ ID NO: 305391 - DNA, 512 bp, Homo sapiens
  misc_feature: GZ8MTXP02FG6B9.10.5.A05.1.454.CMB.2.raw
  modified_base (304)..(304): a, c, t, g, unknown or other
  misc_feature (304)..(304): n is a, c, g, or t
tcagcatagtagtgcacgaccggtgctcgatttagatagatagacagggggctacaacaggcaggcaggggcagcaagatggtgttgcagaccccaggtcttcatttctctgttgctctggatctctggtgcctacggggacatcgtggtgacccagtctccagaatccctggctgtgtctctggcgagaggccaccatcagctgcaggtccagccagagtgttctcttcaacagaaacaataaggatgtttagcttggtaccagcaagaaacccaggacagtctcctaagctgctcatttacngggcagtcgacccgggatcccggggtcctgaccgatcagtgcagcggtctggggacagaacttcactctaccaccatcaaacagccctgccaggctgaagatgtgctagtttattctagtcaacagttactctttctcgtcgtgacgtcggaccagggaccaaggtcgaacctacgaaacgaactgtacggctacgctaccactctcg

SEQ ID NO: 305392 - DNA, 588 bp, Homo sapiens
  misc_feature: GZ8MTXP02IN2TS.10.5.A05.1.454.CMB.2.raw
  modified_base (330)..(330): a, c, t, g, unknown or other
  misc_feature (330)..(330): n is a, c, g, or t
  modified_base (397)..(397): a, c, t, g, unknown or other
  misc_feature (397)..(397): n is a, c, g, or t
  modified_base (505)..(505): a, c, t, g, unknown or other
  misc_feature (505)..(505): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcaggaggtagaaaagcccggggagtctgtgaagatctcttgcacgggttcaggagacagtatttagcagcgactggctcggctggtgcgccagagtggcccggggaggcctggagtggagtggggatcgatcaatctggtanctctacgaaaccagactaccgaccccgttcctccgaacgggtccggtccaccatcgtacacgccganacggtcatcacgtactaccctagttggacgtgatttacgcgttaggaacggcctacgggacacccggccagtcgtattacgtgtaacgagaccgttagggaacgggtnttacggttaatacgtcggacgtcgtaagttcggtacgggggacccgtaacggggtaacccgtcggtacccgaacccgtccccg

SEQ ID NO: 305393 - DNA, 801 bp, Homo sapiens
  misc_feature: GZ8MTXP02G723I.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaggcccgggagtctgtagaagatctcttgcgtacgggttcaggagacagtatttagcagcgacgtggctcggcgtggtgcgccgagacgtcgggacccggggaaggccgtggaggtggagtggggaatcgaagtactaagttcgttaggtacgtctaccgtacgaaaaccgagaacctaccctacccccgttaccgttacccggaaacgggtcccgggtaccaccctacgtaccgtaccgaccggtacccgaacgtaaccggtaccctaagtaccgtaaaccggttaacccttaacccgttaacggttacgggtaacggttacggtaaacgttacggtacccgttaacgggtaaaccggtacccgttaaccggaacccgtaaccccgtaccgttaacgttacgggtttaaacgtttaaccggttacggttaaaaccgggtaacggttaaaccgggtttaaacggggtaaaaccgggggtttactttaaaccggtttaaagtttacgggttacgggaccggttacggtacggttaaccgggtcgggggtaacccgtaacgggggtaaccccgtacgggtaccccgtaaccggttcccccgg

SEQ ID NO: 305394 - DNA, 563 bp, Homo sapiens
  misc_feature: GZ8MTXP02H32F7.10.5.A05.1.454.CMB.2.raw
  modified_base (395)..(395): a, c, t, g, unknown or other
  misc_feature (395)..(395): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcaggaggtagaaaaggcccggggagtctgtagaagatctcttgcgacgggttcaggagacagatttagcagcgactggctcggctggtgcgccagagtggcccggggaaggccgtggagtggagtggggatcatcaatcgttggagtctcctagaaaccagaactaccacccccgttcctccgaagggcccgggtccaccgatccncacgcccgacacggtccatcagttacctacctagttaggagtgattagcctaggacggcctacggacaccgcatagtatacgtgtacgagtacgtacggaacggggtattacgtattagtcggcgtcgagtcgtggggaccgacggggtaccctcggtcaccggtccc

SEQ ID NO: 305395 - DNA, 772 bp, Homo sapiens
  misc_feature: GZ8MTXP02HQ5QN.10.5.A05.1.454.CMB.2.raw
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtcgacccagtctccagaactccctggctgtgtctcgtgggcgaggacgggccaccgatcagctgcgacggtccagccagagttgttctcttacaaacaagaaacaaataaggaattgttaagcttaggaccttagacaacgaaaccgaggactagtcctactaacgctacgcttntaactttacggnggtacacgttaccggaccggtaacgtcccgggtccctacggaccgtagttcgacggtggaccgtagggtccggggtcgtacggggaacctacgggttaaccttccgtaccttaccaccctaaacctactaaccaaaaccgacgtcccgtacggaccgacgtaccggttaaggaaaacgtggttaggtacgggttactttaaaggttttttcgtttaccgttaacggtaaccttaaacggttacgtttacgttttccttttacccgttcccgtttaacgggtcggggttaccccgtttaaccgggtaaccgggttaaaacggggtaaccgggttaaaacgggtaccggttaaaacccgtaacgtaaaaaccggtaccgttaacggggttcggtacccgtttaccggaaccgtttaacctacggtttcctttaacccg

SEQ ID NO: 305396 - DNA, 542 bp, Homo sapiens
  misc_feature: GZ8MTXP02GKIBX.10.5.A05.1.454.CMB.2.raw
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (400)..(400): a, c, t, g, unknown or other
  misc_feature (400)..(400): n is a, c, g, or t
tcagcatagtagtgcacgaccggtgctcgatttagatagatagacagggggctacaacaggcaggcaggggcagcaagatggtcttgcagacccaggtcttcatttctctgttgctctggatctctggtgcctacggggacatcgtggtgacccagtctccagaatccctggctgtgtctcgtgggcgagaggccaccatcagctgcaggtccagccagagtcgttctcttacaaacaagaaaacaataaggtatgttagcttggaccagcaagaaaccaggacagtctccgtaagctgcctntatttacgngggcagtccggaccgggacgtcccggggtccncgaccgtntcgaggtgcaggcgggtntgggacaagtactcactctcacatacaacngcctgcgaggctagaagcgtaggtgtattagtttattctacgtacaacgtgttacttcttcttcgtccgtagtccgttacggaccgaaggacgtaggtacgtactacgaaacgacgtgtacgtctcgaccactatccgttag

SEQ ID NO: 305397 - DNA, 793 bp, Homo sapiens
  misc_feature: GZ8MTXP02GT5K2.10.5.A05.1.454.CMB.2.raw
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccgggagtctgtgaagatctnttgcgtacgggttcaggagacagtattagcagcgactggctcggntggtgccgcgagagtcgggaccccggggaaggccgtgggtaggtaggaggtgggggaactccgaagttcgtaaaacgtttcgtttacgggtacgtaccgttaccgtaaacgaaaacccgtaacggaaccttaacccccgtaacccccccggttaacccccgtttacccgggaaaaccgggggtcccccggggttaacccaaccccgtaacgttcccgttacgaacccgggacccgaaccgtaaccgggtaccctaacgttacccgtaacggtttaacccttaacccgttaaccgtttaggggtaaggttacgggtacgtttaaacggcccgtttaacgggaaaccgggtcccgttaccgggaacccgacccgtacctaagttacgttaacgtttaacccgtggttaaaccgtaacgtaaccggtttagggtaaacccggggttatttacggttaagttaacgtcggacgtacgtagtccggtacgggaccgtacgggaacccgtcggtacccgacccggtcccg

SEQ ID NO: 305398 - DNA, 730 bp, Homo sapiens
  misc_feature: GZ8MTXP02H2K3H.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcaggaggtagaaaaacggcccggggagtcgtgtagaagatctcgttgcgacgggttcgaggagacgagtagtttagcgagcgacgtggctcggcgtggtgcgaccagagtcggcccggggaggccgtaggaggtggagtggggatcatacaagttcgttggagtctaccgtagaaaccagtaactacccgtaccccgttcccttccgaaaccgggtccggtaccaccgtactccgtacaccggacccgacgacggtacctagtaccgaacgtttaaccttaacccgttacgttagggtaacggttaggtacgttacggtaccgttaacggaacggggttacccgtacccgggtaaccgaacccccggtactaacgttcggtttaaacgttaccggttaaacgggtaaccgtaacggtaaaccggtttacgggtaaaacggggtttaactttacgttaacgtttaaggtcgggtaacgccgtaggttccggtcggggaaccgtaccggggtaacccgtccggtaaccgaccccggtaccccg

SEQ ID NO: 305399 - DNA, 743 bp, Homo sapiens
  misc_feature: GZ8MTXP02HAKB4.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggatctgtgaagatctcttgcacgggttcaggagacagatttagcagcgactggctcggctggttgcgccagatggcccggggaaggccgtggagtggagtggggatcgatcgaatcgttggtagtctcctagaaacctagactaacccacccccgttcccttacccggaaacgggcccggggtaccaacccgacttaccgcgaaaccgggcccgaacgtacgggtacccaagttaccgaaacggtttacctaacccgttaacgtttacgggacgttagggtactttaaacggtcccgttaaggaaaccgggtaccccgtacggggaaccctaaacccgggtccctaaagttcggttaaactttaccgtacggttaaccggtaaagtacccggtttaagggtaaaccgggggtatttacgttaaacgtttaaggtcggggtaaccggttcggtaacgttccgggttacggggggtacccccgaaaacgggggttaaacccccgttcggggtacccgtaaacccccgggtttccccg

SEQ ID NO: 305400 - DNA, 631 bp, Homo sapiens
  misc_feature: GZ8MTXP02IE689.10.5.A05.1.454.CMB.2.raw
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctcgtgggcgagagggccaccatcagctgcagtccagccagngtgtctctcaacagaaacaataaggatgttagcttggaccagcaagaaaccnggacagtctacctaagctagctactattttacgnggacacgtccggaccggtacgtccgggtcctacgacctatcgaggtcggcgacgggtccggggtcgtagggaactaagtacttcacttcccacaccactacaacacgccgtagacgaggactaaggagtagtggttacggtactttaagtttttacttcgtacgtaactaacgttacgtttacttcgttttccttccgttaccgggttacggttacccggttaccgggaaccggtaaacggggtaaccgtaaaggggtaccgtaaaccgtaaccgtaaacgtacgttcggtacggaccgtcggaacctaccgttacttaccgtcg

SEQ ID NO: 305401 - DNA, 781 bp, Homo sapiens
  misc_feature: GZ8MTXP02JXI4G.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcggagcagaggtgaaaagcccggggatctgtgaagatctcttgcacgggttcaggagacagtatttaagcagcgactggctcggctggtgcgccagatcggcccggggaaggccgtggagtggatgggggatcgatcgaaagttctttaggatcgtctacgaaaacctagaacttacccaacccccgttccgttcccgaaacggggtcccgggttaccaaccgtacgttcccgttacgaaccggtcccgaaaccgtaacggggttacccaacggttaccctaacggttaacccttaaccccgtttaacggtttacgggtaagggtttaggggtaactttaaacgggtcccgttaaaggggtaaaccggggtccccgttaccgggggtaaccctaaccccggggaacccctagtttacggtttaacgtttaaccgttacgggttaaaccggaagttaaacggtttacggggtaaaaccgggggttatttacccgttaaaggtttaccgttaagggccggtacggtaacggttccggtcgggggtaacccggtaaccgggggtaaccccggtcgggtttacccggaacccggttacccccg

SEQ ID NO: 305402 - DNA, 783 bp, Homo sapiens
  misc_feature: GZ8MTXP02F7OYG.10.5.A05.1.454.CMB.2.raw
  modified_base (331)..(331): a, c, t, g, unknown or other
  misc_feature (331)..(331): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgaggacgggccaccatcagctgcaggtccagccagagttgttctcttacaacagaaacaataaggaattgttagcttaggtaccagacaacgaaaccgaggacacgttacctaccgtaaagctacgtctactagtttaaccgnggggtacctaacggttaccccgggaaaccccggggtaacggttcccccgggggttacccctaccggaaccccgttagtttccgaacgggttcggacgtacggggtccggggtcgtaagggggaacctaagtaacctttccgaccttacctacccaaaccctaactacccgaaaccgtacggtccctaacggccgaacggtaccgtaagggaaaacgtgttacgggtacggttaccgtttaagtttttactttacggtacgttaaaccaaacggttagtttacctttaccgtttttaccgttccggtaccgggtttcgggtaaccggtttaccgggaaaccgggaaaccggggtaaaccgtaaacggggttacgtaaaacccgttaaaacgaaaacccgggttaactggggtaccggtacgtacgtaccctaaccgttacttccgtttaccgg

SEQ ID NO: 305403 - DNA, 628 bp, Homo sapiens
  misc_feature: GZ8MTXP02G8VRE.10.5.A05.1.454.CMB.2.raw
  modified_base (357)..(357): a, c, t, g, unknown or other
  misc_feature (357)..(357): n is a, c, g, or t
  modified_base (555)..(555): a, c, t, g, unknown or other
  misc_feature (555)..(555): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaagcccggggagtctgtgaagatctcttgcacgggttcaggagacagattagcagcgatggctcggctggttgcaccagacgtcggccccggggaaagccgtggacgtggagtggggactcgatacaattcgttaggtacgtctaccgtagaaaaccngaactaccgacccccgttcttccgaaacgggtcccgggtacaccgatcgtacacgcccgacacggtccaagtccagtaccttaccgtacgttgggaagtgtaacttacggccgttaggaacggtccgtacgggacctacccgccgtaagtacgttaacgttacgtaggttaaccgagtaccggttaggaaaccgggtnttaccgttagtacgtcggacgtagtacgtcggtacgggtaccgaacggggtaccctgggtacccacccgtccc

SEQ ID NO: 305404 - DNA, 652 bp, Homo sapiens
  misc_feature: GZ8MTXP02HS3W3.10.5.A05.1.454.CMB.2.raw
  modified_base (582)..(582): a, c, t, g, unknown or other
  misc_feature (582)..(582): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcaggaggtagaaaaggcccggggagtctgtagaagatctcttgcgacgggttcaggagacagtacttagcagtcgacgtggctcggcgtggtcgcgtaccgagtacgtcgggaccccggggaaggccgtaggaggtggaggtcggggatcgactactaagttcgttaggtcgtctaccgtaacgaaaccagtaactacccgtaccccccgttcgttacccgaagggtcccggtaccacctactccgtacacggacccgtacgacggtccactcgaacgttaaccctaccgttacgttggacgtaggtacttacgccgtaggaacggtccgtacggaccaccgactagttacgtacttacgacgtaacgtagtaaccgttaggaaacgggtttnttacgtagtacggcgtacggacgtacggtcgggacggaccgtaccggtaccgtaccggacctaccgtccg

SEQ ID NO: 305405 - DNA, 738 bp, Homo sapiens
  misc_feature: GZ8MTXP02J02N4.10.5.A05.1.454.CMB.2.raw
tcagcatagtagtgcacgaccggtgctcgatttagatagatagacatggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaggcccggggatctgtgaagatctcttgcgtacgggttcaggagacgagtattagcagcgactggctcggtcgtggtgcgccagagtcggccggggagcgtggagtggagtgggatcagtcaagttcgttaggtacgtcctactacgaaaacctagactacccgtaccccgtccttaccgaaacgggtcccggtacacccgtactccgtaccgacgtcccgtaagaccgggtacctaacgtacctaacggttaacccttaacccgttacggttacgggtacgttacgggttaaacgttaccggtacccggttaagggaaccgggttaccccgtaaccgggaaccccgttaaccccggacccttaaggtacggtttaacgttaaacccgttggtaaaccggtaacgtaaccggtttaaggggaaacccggggttatttaaacccggttaagtttacggtacggccggtactaacgggttccgggtacgggggacccggtaaccggggttaaccccgtacggggtacccccgtaccccgg

SEQ ID NO: 305406 - DNA, 742 bp, Homo sapiens
  misc_feature: GZ8MTXP02IFO9C.10.5.A05.1.454.CMB.2.raw
  modified_base (250)..(250): a, c, t, g, unknown or other
  misc_feature (250)..(250): n is a, c, g, or t
  modified_base (645)..(645): a, c, t, g, unknown or other
  misc_feature (645)..(645): n is a, c, g, or t
tcagcatagtagtgcacgaccggtgctcgatttagatagatagacagggggtctccttcactgcccagctgggatctcagggcttcattttctgtcctccactatcagtggggtcaaccgccatcctcgcccctcctcctggctgttctccaaggagtctgtgccgaggtgcagctggtgcgaggtcgggagcgaggaggtagaaaacggcccggggagtcgtgtagaagtatctcgttgcgtacggttnaggagacagtagtttagcagcgactggctcggctggttgcgccgagagtcggcccggggaagccgtaggaggtggaggtggggactcgatactaagtccgttggtactcgtaccgtaacgaaaccgagtacctaacccgtacccccgttacccttaccggaaccggggtcccggaccctacccgtaacgttcccgaccacccgggtacccgtacgtaaccggtcccaactccgttaaaccgttaaccttaacccgttacggttaacgggtacggttacgggtaacttaaccggccgttaacgggaaccggtcccgtaccgggaacccacccggtacctaagttacgttacttacggtacggtacgtaacgtaaacgttcgggaaaaccgggtttnttaacgttaaggttacgtacgggaccgtacgtacggtaaccgggttacggggaacccgaaccggggtaacccgtccggtaccctacccggtcccccg

SEQ ID NO: 305407 - DNA, 575 bp, Homo sapiens
  misc_feature: GZ8MTXP02GDVCA.10.5.A05.1.454.CMB.2.raw
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaatccctggctgtgtctcgtgggcgaggagggccaccatcagctgcaggtccagccagagtgttctcttacaacagaaacaataaggaattgttagcttggtaccagacaagaaaccaggacagtcctaccgtaagctgctactatttacgngggcagtccgggaacccggtagtccccggggtccctacggaccgtattcgaggtcgacgagggcgggtcgngggacagtaattcactctacaccanacaacngcccngacagctagaagntggtagcttagtttnttcgtagtacaaactgttacttctttctcgtccggtgaccgttacggacgtaaagggacctaaagggtcgtaaaccgtacgaaaacgtaacgtggtacgcgtacgaccgtacctacgtctttacg

SEQ ID NO: 305408 - DNA, 690 bp, Homo sapiens
  misc_feature: GZ8MTXP02HL3C9.10.5.A05.1.454.CMB.2.raw
  modified_base (608)..(608): a, c, t, g, unknown or other
  misc_feature (608)..(608): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcgagaggtagaaaaacggccggggagtctgtagaagatctcttgcgtacgggttcaggagacagtattagcagcgactggctcggctggtgcgccagatcggcccggggaagccgtggacggtggagtggggactacgtatcgaaatcgttaggtacgtctccgtacgaaaccagtacctaaccgacccccgttccttacccgaaacgggtccgggtaccacccgtactccgtaccgacggacccgtaacgtacggtacccagtccgtaacgtaacccttaccgttaacgttagggtaaacgttagggtaacgtttacggaccgtttaagggaacccgggttccgtaaccgggacccgaacccgtccgaagtttacgtactttacgtagtaacgtagtacgtttacgggaaacgggttntttaccgtaagttacgtcggccgaacggtacgtaacggtcggggaccggtacgggtaacccgtcggtaccgaacccgtcccg

SEQ ID NO: 305409 - DNA, 570 bp, Homo sapiens
  misc_feature: GZ8MTXP02JBCWA.10.5.A05.1.454.CMB.2.raw
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
  modified_base (457)..(457): a, c, t, g, unknown or other
  misc_feature (457)..(457): n is a, c, g, or t
tcagcatagtagtgcacgaccggtgctcgatttagatagatagacagggggctacaacaggcaggcaggagcagcaagatggtgttgcagacccaggtcttcatttctctgttgctctggatctctggtgcctacggggacatcgtggtgacccagtctccagaatccctggctgtgtctcgtgggcgagacgggccaccatcagctgcaggtccagccagagttgttctcttacaacaagaaaacaataaggaattgttancttaggaccagacaagaaaccaggacagtctcaagctgctcatttacgnggcagtccgacccgggagtcccgggtcccctagaccgattcaggtcggacngggcggtcgtagggactagtacttcactccacaccatacaacngccngcaggctagagagtgnggtacttagtttactttcgtagtactaacgtnttacttcttcttccgtcgtcggtaccgttcggaaccgtaacgggacgtaaacgggtacgtaaaccgtacgaaaacgtaacgtgtacgggtctcggacctaccgtacgtttccg

SEQ ID NO: 305410 - DNA, 758 bp, Homo sapiens
  misc_feature: GZ8MTXP02IYGSQ.10.5.A05.1.454.CMB.2.raw
  modified_base (227)..(227): a, c, t, g, unknown or other
  misc_feature (227)..(227): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaaggcccggggagtctgtgaagatctnttgcacgggttcaggagacagattagcagcgtactggctcggctggtgcgccagacgtggacccggggaaggccgtaggaggtggagtggggatcgatacaagttcgttaggtacgtctaccgtacgaaaaccgagtaactaccccgacccccgttccttaccggaaaccggggtcccgggtaccaaccgtacttccctacgaaccggacccgaccgtaacggttacccaagttccgtaaacgttaacccgttaacccgttaacggtttacggggtaacggttacgggtaaacgttttacgggacccgttaagggaaacccgggtcccgttaacccggggaacccgaaccccggtacccgtaagttacggtttaaacgttacgttacgggtaaccgtaacgtacggtttacgggaaacggggttactttacgttacgttacggttacgggaccgtacggtaacgtaaccgggtaccgggggacccggtaacgggggtaaaccccgtcggggtacccaaccccggttccccg

SEQ ID NO: 305411 - DNA, 585 bp, Homo sapiens
  misc_feature: GZ8MTXP02JYJAO.10.5.A05.1.454.CMB.2.raw
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcggagcagaggtagaaaaaggcccggggagtctgtagaagatctcttgcacgggttcaggagacagtattagcagcgacgtggctcggctggttcgcgccaggactgggccccggggaaggccgtggaggtggagtggggatcgatataatcgttaggtagtctactacgaaaccagaactaccacccccgttccgttaccgaaccgggtccggtacaccgactcgacacgccgacgaggtcccatcgaagtactacctacttcggagtgacttagccgtagacgtccgtcggacctacgccagttagtacttacgtagtacgagtacgttaggaacgggtatcgtaatacgtacggcgacgtagtcgcggggtaccgacggtacctggtcccaccgtcccg

SEQ ID NO: 305412 - DNA, 734 bp, Homo sapiens
  misc_feature: GZ8MTXP02FNKIY.10.5.A05.1.454.CMB.2.raw
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgcctacggggacatcgtggtgacccagtctccagaactccctggctgtgtctcgtgggcgagacgggccaccatcagctgcaggtccagccagagtcgttctcttacaaacagaaaacaagtaaggaattggttagcttaggtaccagacaacgaaaccaggacagtcctacctaagctgctnatttacgnggcagtaccggacccggtaagtcccggggtcctacggtaccgtatcgaggtggtccgagggtccgggctaggggactagtaacttccactcgtacaccgactacgaaacacgtccctgaccgtaaggtcgtaaggaaagtagttacgggttacggtaaccgtttaagttttaacgttttctacggttaaacctaaccgttacgttttactttacccgtttttccgttacccggttccggttaacggggttacccggttaaccggggtaaccccgggtaaaagggggtaaaccccggtaaagggggtttaccgggtaaaaccctttaaaaccgaaaacccggggtttaacgtaaccggggtttaacccggaccgtttaccggacccgtaaaccctaacgtttccggtttaacccg

SEQ ID NO: 305413 - DNA, 709 bp, Homo sapiens
  misc_feature: GZ8MTXP02G43Z1.10.5.A05.1.454.CMB.2.raw
  modified_base (615)..(615): a, c, t, g, unknown or other
  misc_feature (615)..(615): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcagaggtagaaaacggcccggggagtctgtagaagatcttcgttggacgtacgggttcagggagacgagtattagcaggcgacgtggctcggcgttggtcgccgccagcgtcgggacccggggaggccgtggaggtggaggtggggactacgatacgtaagttcgttaggacgtctaccgtaacgaaaaccaggtaaccttaccccgtacccccgttccgttaccggaaccggggtcccgggtaccaccgtacttcgtaccgacggtacccgagaccggtccacgtacgtaacgttaaccttacccgtagttagggtaacgtggtaacgttacggccgtacggtaaccggtccgtaccggaccgtaccgacctagttacgtacgttacgtacggtacgtacgtaccgttaagggaaaccgggtttnttaaccggtattacgggtcggtaccgtacgtacggtccgggttaccggggaaccggtaccggggtaacccgtcggtaccccgacccggttcccg

SEQ ID NO: 305414 - DNA, 666 bp, Homo sapiens
  misc_feature: GZ8MTXP02HVN5S.10.5.A05.1.454.CMB.2.raw
  modified_base (187)..(187): a, c, t, g, unknown or other
  misc_feature (187)..(187): n is a, c, g, or t
  modified_base (283)..(283): a, c, t, g, unknown or other
  misc_feature (283)..(283): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctctcctggctgttctccaaggagtctgtgccgaggtgcagctggtgcagtcgggancagaggtgaaaagcccggggagtctgtagaagatctcgttgcgtacgggttcaggagacagtatttagcaggcgactggctcggctggtgcgcagngtggcccgggaaggcctggagtggagtggggattcgagtcaaattcgttggtagctacgtagaaaccagactaccgaccccgttccttccgaaacggtccgggtacctacccaatccgtacacgacccgaacgacggttccacgtaccaagttaccctaccttacgttacggaaacgggttgtaagttacgtacccgtaggaaaggtccccgttacgggacccacccgacgtacgtagttaaacttacgtacgttaacggacgtaacgtttacggaaaacggggttattaccgttagttaacgttaggtccgacggttaacgtaacggttcggggacccggacggggaaaccccctttcggggtaacctaaccccggtccccg

SEQ ID NO: 305415 - DNA, 722 bp, Homo sapiens
  misc_feature: GZ8MTXP02JE7CK.10.5.A05.1.454.CMB.2.raw
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtgacccagtctccagaactccctggctgtgtctcgtgggcgagagggccaccatcagctgcaggtccagccagagtgttctcttacaacaagaaacaataaggaattagttagcttaggtaccagacaagaaaccaggaactagtcctacctaaagtctgacctactagtttaccgcggggactacgtacccggaaccgggtacgtccccggggtccctaccggaacccgtacgttacgacggttcggaccgtaacgggtccgggggttacgtacgggggtaaactaacgttaaacgtttccgaaccgttcccttaacccgaaacctaactaccgaaaccgtacgacccgttacgaccgtaaacggggtccttaagggaaaacgtacggtttagggtacgggttaccgtttaaggtttttacgtttaccgtacgggtaacctaaacgttacgtttaactttccgttttacgtaccgttcggtacggtacggttaccggaccgtaacggggtaccgtaaggtacggaacttaacgaaacggtagtcgtacgtactcgaccgtactacgtctacg

SEQ ID NO: 305416 - DNA, 703 bp, Homo sapiens
  misc_feature: GZ8MTXP02IYJMN.10.5.A05.1.454.CMB.2.raw
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (648)..(648): a, c, t, g, unknown or other
  misc_feature (648)..(648): n is a, c, g, or t
tcagcatagtagtgcacgaccggtgctcgatttagatagatagacagggggtctccctcactgcccagctgggatctcagggcttcattttctgtcctccactatcatggggtcaaccgccatcctcgccctcctcctggctgttctccaaggngtctgtgccgaggtncagcgtggtgcaggtcgggagcaggaggtaaggaaaaggcccggggagtctggtagaagtatcttcgttgacgtacgggttacaggagactagtagtttagacgagcgagtggcgtcgggcttggtcgccgaccgtagacgtcggggacccggggtaaggccgtaggggacgtagggtacgtagggggacttacgtaacgttactaacggtttcgttagggtacggtctaccccgtaacgaaacccgtaacgtaaccttaacccccgtaccccccggttaccgttaccggggaacccgggtaccgggtaccctaacctcgtacgtaccgacggaccgtacgaccgtcctacgttaccgtagttaacccttaccgttaggttggtacggtagtacttacgaccgtaggaaaccgtcccgtaaccggaccggaacctcgtagttacgtattacgcgtactaggtacttacgggaacgtttnttacgtagtcgtcgacgtacgtagtcggacggtacgacgtcgcgtaccgacgtcc

SEQ ID NO: 305417 - DNA, 681 bp, Homo sapiens
  misc_feature: GZ8MTXP02IST0M.10.5.A05.1.454.CMB.2.raw
  modified_base (231)..(231): a, c, t, g, unknown or other
  misc_feature (231)..(231): n is a, c, g, or t
tcagcatagtagtgcacgaccggtgctcgattttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcaggtcgggagcaggaggtagaaaaggcccggggagtctggtagaagatctnttgcgtacgggttcagggagacgagtattagcaggcgacgtggctcggcgtggtcgccgacagagtcggacccgggagcgtggaggtggagtggggatcatcgtaagttcgttggtacgctaccgtacgaaacctagtactaccctacccccgttaccgttccggaacgggtcccgggtaccacctactacgtacgaccggtacccgacgtaccggtacctaacgtccgtaacgttaaccttaccgttaacggttagggtaacggtacgttacgttaacggtacccgtagggaaccggtcccgtaccggaccgacccgacctagttacgttaacgttacgtacgtaaacgtcgttaacggttacgggaaagggttcttacgtagtttacggcgacggtacgcgttaacggccgggacgtaaccgggtactaccggtccgacccgttcccg

SEQ ID NO: 305418 - DNA, 669 bp, Homo sapiens
  misc_feature: GZ8MTXP02H9WEH.10.5.A05.1.454.CMB.2.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
tcagcatagtagtgcacgaccggtgctcgatttagatagatagacagggggctacaacaggcaggcaggggcagcaagatggtgttgcagacccaggtcttcatttctctgttgctctggatctctggtgccgtacggggacatcgtggtgacccagtctccagaactccctggctgtgtctctgggcgagagggccacatcagctgcaggtccagccagagtgtctctcaacagaaacaanaagatgttanctgaccagacanaaaccaggacagtctacctaagctgactctatttacgtgggacatccggaaccccgggtatccccggggcctaccggaccgtattcgaggtcggacgtacggccggggttcgtcggggaactaaggtaaacttcgaacttccctacaacccatacccgaaacagccctgacgtacgatagggaagtagttgggacggtacttaggttttaaacttttcgggtacgtaactaaaccgttaagttagttccctttttaccgttacccgtttccgtaccgggggttaacccggtttccggaccggtaaaccgggggaaacctaaacggggttaccggaaaacctaacctaaaaacggggtaccctaaggtccgggtattaccgaccgtaacccctataccgtttccgg

SEQ ID NO: 305419 - DNA, 554 bp, Homo sapiens
  misc_feature: GZ8MTXP01B1KO9.21.47.E03.1.454.CMB.2.raw
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (399)..(399): a, c, t, g, unknown or other
  misc_feature (399)..(399): n is a, c, g, or t
tcagtcgtcgctcgcacgaccggtgctcgatttagactcgcgcacagagagaaggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggtagcctggtatcagcagaaaccaggaaagcccctaaatcctgatctatgctgcatccacgttgcaaagtggacgtcccgtnaaggttcagcggcnggtgggtctggggacgtatttcaatctcaccatcaccagcctagcagcctagaacgtnttttagactaactttattattgtacaacgaggtcctaaactacgttttcctacgttcaaccggtttcgggcggtacggggacctaaacgggttgggaacggttacaaaacggaaccgttgggtcggcttcggccacccgattccgttggtttccc

SEQ ID NO: 305420 - DNA, 595 bp, Homo sapiens
  misc_feature: GZ8MTXP01CKOEJ.21.47.E03.1.454.CMB.2.raw
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (346)..(347): a, c, t, g, unknown or other
  misc_feature (346)..(347): n is a, c, g, or t
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttancctggtatcagcaagaaaccaggaaaacncccctaaatcctagatctatgctgcatccagttgacaaagtgacgtccgtanaaggtcaggcggnnggtgggtcnggggacgtattcatctcacatcacngcctgcagcctagaactatttgaccttaagtttattagttcgtactaaacgtggtaaccttaacgttacgtttttccctcgtaccgtaaccgggttcggggaaccgggtaacgggttaacccgtaaacgggttggggaaaaccggtttacgaaaaaccgggttcgttacgggtgggtaccttcggaccctaccgttatttccgttgtttaaccc

SEQ ID NO: 305421 - DNA, 613 bp, Homo sapiens
  misc_feature: GZ8MTXP01ELR1E.21.47.E03.1.454.CMB.2.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (426)..(426): a, c, t, g, unknown or other
  misc_feature (426)..(426): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtagganacagagtcaccatcacttggtcgggcgagtcgagggttattagactaacgtggttanccgtggtatcagacaagaaaccaaggaaaacncccctaaatcctagatctatgctagctatccagttgacgaaaggtcggaccgtcccgtanaaggtcaggcgcgtggtgggtcgtaggggacgtatttcgaatctacacatccacagcctagcacgctagaagttntttagaccttaatttattattcgtaacaaacgtcggtaccttaacgttacgttttccctcgtaccgttacggttcggggaacggtaacgggaacccgtaaagggttacgggaaacggttaccgaaaaacggttcgttcgggtaacgggaccttcggacctacccgttattccggtttgtttaacccg

SEQ ID NO: 305422 - DNA, 551 bp, Homo sapiens
  misc_feature: GZ8MTXP01CCNP2.21.47.E03.1.454.CMB.2.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (346)..(347): a, c, t, g, unknown or other
  misc_feature (346)..(347): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtaggagacagagtcaccatcacttggtcgggcgagtcgaaggggtattagcaacgtggttancctggtatcagcaagaaaccaggaaaacncccctaaatcctagatctatgctgcatccagttnacaagtgacgtccganaaggtcagcgnnggtgggtctgggacgtatttcgaatctacaccatccacacgtcctgctagcctagaatatttgacttaacgttatttattagtactaaacgaggtaccttaaagtacgttttcctcgtacgtacggttcgggaacggaagggaccgtaacggttggaaggtacaaacgttacgttggtggcctgccaccgttatccgttgttcc

SEQ ID NO: 305423 - DNA, 571 bp, Homo sapiens
  misc_feature: GZ8MTXP01EEB6W.21.47.E03.1.454.CMB.2.raw
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (438)..(438): a, c, t, g, unknown or other
  misc_feature (438)..(438): n is a, c, g, or t
  modified_base (480)..(480): a, c, t, g, unknown or other
  misc_feature (480)..(480): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagatcacatcacttggcgggcgagtcgagggtattagctaacgtggtagcctggtatcagacaagaaaccaggaaaacncccctaaactctagatctatgctgctatccagttanactaaagtcggaccgtcccgtanaaggtcaggcggactgggtgggtacgtggggacgtattacgatcctacacactcaccagcctgaccagactagtaattatttagacttaaacgtttnttaagttcgacaacgtagtaccttaacgttacgttttccctntacgtacggtcggaacgggacgggttaaccctaagggttaggacgtaacgaaacggttcgttcggtggctcgacacgttatcgttcgttcc

SEQ ID NO: 305424 - DNA, 613 bp, Homo sapiens
  misc_feature: GZ8MTXP01E2VZX.21.47.E03.1.454.CMB.2.raw
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (347)..(348): a, c, t, g, unknown or other
  misc_feature (347)..(348): n is a, c, g, or t
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcaccatcacttggcgggcgagtcagggtattagctaacgtggttancctggtatcagcaagaaaccaggaaaacncccctaaactcctagatctatgctgcatccagttnacaaagtgactccgtanaaggtcagcgnnggtggngtgggacgtattcatctcaccatcacagctncagcctagaactattttcgacttaaactttattattacgtaccaaaacgtgggtacctttaaacgttaccttttccctccgttaccggtaaccgggtttccgggggaacggggtaaacggggttaaaccccgtaaacggggttgggtaaacggttaacccgaaaaccggttaaccgttgggtaacggcttaacggaccctaacccgttattcccgttcgtttaacccc

SEQ ID NO: 305425 - DNA, 624 bp, Homo sapiens
  misc_feature: GZ8MTXP01A6807.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcaccatcacgttggtcgggcgagtcgaggggttattagcaactggttagcctggtatcagacaacgaaaccgaaggaaaacctacccctaaactcctagacttctatgctgctactccgtacgttgacgtaaaggtcggacccgttcccgtagtaacggttcaggtccgggacgtaagggttcgggtcgtaggggtacgtatttacaacgttcaccactactccacagcctggacctacgtcctaggaattgtttacgaacttaactttatttaattcgtaactaagtacgtacttaacgttacgtttcctacgtcgtacgggttcgggaacgggtacggaaccgtacggttaggaaacgtaacaaacggttcgttgggtaacgctcgacctacgttacttccgttcgtttaacc

SEQ ID NO: 305426 - DNA, 585 bp, Homo sapiens
  misc_feature: GZ8MTXP01EN5W9.21.47.E03.1.454.CMB.2.raw
  modified_base (202)..(202): a, c, t, g, unknown or other
  misc_feature (202)..(202): n is a, c, g, or t
tcagtcgtcgctcgcacgaccggtgctcgatttagactcgcgcacagagagaagggggcaggagtcagacccagtcaggacacagcatggacatggagggtccccgctcagctcctggggctcctgctgctctggttcccaggttccagatgcgacatccagatgacccagtctccttcttccgtgtctgcatctgtagganacagagtcacatcattgtcgggcgagtcgagggttattagctaactagtagctggtatcagacaagaaaccaggaaaactcccctaaatcctagatctatgctgactatccgagttgacaaaggtcgaccgtcccgtagaaggtcaggcggcaaggtgggtacgtaggggacgtatttcaatctacacatcacagctgcagctagaacgtatttacgacttaacttattagttatacgaaactacggtacttaaacgttacttttcctcttacgtaccggttcgggaacggtaacgggttaccctaaagggttcggaaacggtaacgaaaacggttaccggttggtaaggtcctggacctaccttattccgttaacgtttccc

SEQ ID NO: 305427 - DNA, 579 bp, Homo sapiens
  misc_feature: GZ8MTXP01BHYQ1.21.47.E03.1.454.CMB.2.raw
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgaggggtattagcaacgtggtancctggtatcagcaagaaaccaggaaaacncccctaaatcctgatctatgctgcatccagttgacaaaggtcggacgtcccgtanaaggtcaggcggacnggtgggtcgtggggacgtattcaatctacacatcaccacgcctgcagcctagaagtatttagacttaacgtttatttattcgtactaactaggtacttaacttacgttttcctcgttaccgtacggttcgggaacgggtaacgggacctaaacgggttggaacggttaaccaaaacggttcgttggtaacggtctaacgcctaccgttattccgttcgttaaccc

SEQ ID NO: 305428 - DNA, 601 bp, Homo sapiens
  misc_feature: GZ8MTXP01CB9B2.21.47.E03.1.454.CMB.2.raw
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttggtcgggcgagtcgagggttattagcaacgtggttancctggtatcagcaagaaaccaggaaaacncccctaaatcctgatctatgctgcatccacgttgacaaaggtggaccgtcccgtanaaggttcaggcggcnggtgggtcgtgggacgtatttcgaatctcacatcacagctgcagcctagaacgtntttcgacttaaactttatttacgttcgtaactaacgtacggtcttaaacgttacgtttttccctcttccgtacggtttcggggaaccgggtaacggggttaaccctaaacgggttgggtaaacggtaccgaaaaaccggttacgttcggtaacgggcttcggacccacccgttattccgttaagtttccc

SEQ ID NO: 305429 - DNA, 761 bp, Homo sapiens
  misc_feature: GZ8MTXP01C96YO.21.47.E03.1.454.CMB.2.raw
  modified_base (205)..(205): a, c, t, g, unknown or other
  misc_feature (205)..(205): n is a, c, g, or t
tcagtcgtcgctcgcacgaccggtgctcgatttagactcgcgcacagagagaagggggcaggagtcagacccagtcaggacacagcatggacatggacgggtccccgctcagctccgtggggctcctgctgctctggttcccaggttccagatgcgacatccagatcgacccagtctccttcttccgtgtctgcatctgtagganacagatcaccatcacgttggcgggcgagtcgagggtattagacaacgtggttacgcctggtactcgagacaaacggaaaccgaaggaaaacctccccctaaaatcctagactactatcgctgactacgtaccgtagttacgaacgtaaaggtcggtaacccgttaccccggtagtaaaggggttccgaacgggtccgggtacgtaagggggttcgggttaccgggtaacgggggtaaccggtaattttaccgaaacttccctacccaaccgtaactacccgaaccgtaacgtcccgtagacccgtaacggtacccgttaaggtaaacgtttacgtttttacgaaaccctttaaaacggtttttaattttaacgtttacgtaaaccgtaaaccgtaggttaaccctttaaacgtttaaccgtttttcccaaccgtttcccggtaaccggggttcggggaacgggttaaacgggaacccggtaaagggttcgggaaacgggttaacaaaaccggttgttacggtcggacgtcgacctaccgttagttcttaacgttcc

SEQ ID NO: 305430 - DNA, 603 bp, Homo sapiens
  misc_feature: GZ8MTXP01EWNT2.21.47.E03.1.454.CMB.2.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcttccttcttccgtgtctgcatctgtagganacagagtcaccatcacttggtcgggcgagtcagggtatagcaactggtagcctggtatcagcaagaaaccaggaaaacncccctaaaatcctagatctatgctgcatccagttgacaaagtggaccgtcccgtanaaggttcagcggcnggtgggtcgtggggacgtatttacgaatcctacaccatacaccagcctgcagcctagaagtatttagacttaaacgtttatttattacgtacaaacgtaggtaccttaaacttacgttttcctcttaccgtaccggttcggggaacgggtaacgggttaaccgtaaacgggttagggaaacggttaaccgaaaacggttaacgttgggtaacggacttaacggacctaccttacttccgttcggtttaaccc

SEQ ID NO: 305431 - DNA, 583 bp, Homo sapiens
  misc_feature: GZ8MTXP01AN7CO.21.47.E03.1.454.CMB.2.raw
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggtancctggtatcagcaagaaaccaggaaaacgcccctaaatcctgatctatgctgcatccacgttgactaaagtcggacgtcccgtanaaggttcagcgcnggtgggtctggggacgtatttcgaattctacacatcaccagccctagcagcctagtaatactttagactaacgtttattaagtttcgacctaacgaggtaccttaaacgttacgttttccctaccttacgtaaccgggtttcggggaaccgggtaacgggttacccgaaacgggttgggaacgttaacgaaacgttacgttggtcgggactcggctacccttattccttggttcc

SEQ ID NO: 305432 - DNA, 546 bp, Homo sapiens
  misc_feature: GZ8MTXP01DS8WD.21.47.E03.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (524)..(524): a, c, t, g, unknown or other
  misc_feature (524)..(524): n is a, c, g, or t
  modified_base (538)..(538): a, c, t, g, unknown or other
  misc_feature (538)..(538): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagatcaccatcacttgtcgggcagtcagggtattagcaacgtggtagcctggtatcagcaagaaaccaggaaaacncccctaaatcctagatctatgctgcatccagttnacaaagtcgactccgtanaaggtcagcgcnggtgggtcnggggacgtatttcgaattctacactatcaccagcctgcagtccagaagtntttagactaaagtttattattcgtacaaacnggtacttaacgtacgttttcctacgttcgaccggttcgggcggtaacgggacctaaacgggttgggaaacgttaccgaaaacgacgttggngactcgacaccttntcgttgtc

SEQ ID NO: 305433 - DNA, 615 bp, Homo sapiens
  misc_feature: GZ8MTXP01DZ8ZC.21.47.E03.1.454.CMB.2.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (601)..(601): a, c, t, g, unknown or other
  misc_feature (601)..(601): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtccttccttcttccgtgtctgcatctgtagganacagagtcaccatcacttggtcgggcagtcagggttattagctaactggtancctggtatcagacaagaaaacccaggaaaacncccctaaaatcctgatctatgctgcatccagttgacaaaggtcggaccgtcccgtagaaggttcaggccggactgggttcgggtctaggggtaccgtattttcgaaattccctacacctatccaccgtacgccctagcgtacgtcctaggtaacgttattttacgacttaacgtttatttacgttacgtacctaaacgtacggtacctttaacgttacgtttttcctctccgtacggttcgggaacgggtaacgggaccgtaacgggttggtaacgtaaccgaaacgttcgttggtcggactcggcctaacttnttccgttcgtttcc

SEQ ID NO: 305434 - DNA, 632 bp, Homo sapiens
  misc_feature: GZ8MTXP01BXZ8R.21.47.E03.1.454.CMB.2.raw
  modified_base (201)..(201): a, c, t, g, unknown or other
  misc_feature (201)..(201): n is a, c, g, or t
  modified_base (341)..(341): a, c, t, g, unknown or other
  misc_feature (341)..(341): n is a, c, g, or t
tcagtcgtcgctcgcacgaccggtgctcgatttagactcgcgcacagagagaagggggcaggagtcagacccagtaaggacacagcatggacatgagggtccccgctcagctcctggggctcctgctgctctggttcccaggttccagatgcgacatccagatgacccagtctccttcttccgtgtctgcatctgtagganacagagtcaccatcacgttgcgggcagtcagggtattagctaacgtggttagcctggtatcagacaagaaaccaggaaacgcccctaaactcctgatctatgctgacatccagttagacaaagtcggacgtcccccgtanaaggttcagcggactagggtcgggtcgtaggggacgtatttaccgaacttcaccacctacgtaccaccaggccctgaccacgtcctagaacgtagtttcgacttaacttattattacgtacaacgtagtaccttaacgtacgttttaccctcgtccgtacggttccgggacgggtaaacgggtaacccgttaaacgggttacggaacggttaacccgaaaacggttaccgttcgggttcggtaaccgttacgcctaacccgtacgttcccgttcgtttcccgtttaacccg

SEQ ID NO: 305435 - DNA, 562 bp, Homo sapiens
  misc_feature: GZ8MTXP01D43PH.21.47.E03.1.454.CMB.2.raw
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcaggggtatagcaactggtagcctggtatcagcaagaaaccaggaaaacgccccctaaaatcctagatctatgctgcatcacgttnacaaagtggactcccgtanaaggttcaggcggcnggtgggtctggggacgtatttcgaatctacacatacacagcctcgcacgacctagtaacgtaatttagtacttaaacgtttaatttatagtttttacaacgtacggtacttaacttacgttttacctctccgtacgttcggaacgggtacgggacgtaacggttaggtaagtacgaaacgttacttgtgtcgtcgtcacttactcttcgttcc

SEQ ID NO: 305436 - DNA, 532 bp, Homo sapiens
  misc_feature: GZ8MTXP01AJHG6.21.47.E03.1.454.CMB.2.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagctaactggttancctggtatcagcaagaaaccnggaaaacncccctaaatcctagatctangctgcatccagttnacaaagtgacgtcccgtanaaggttcagcggcnggtggtctagggacgtatttcaatctcacatcacagctgcagcctagaagtntttgactaactttattacttgaccaaagcgtacttaacgttagttttccctcgtaccgtacggtcgggaacggacggaccgtacggttggaacgtacgaacgttcgttggtgctcgacacttattcgttgtc

SEQ ID NO: 305437 - DNA, 603 bp, Homo sapiens
  misc_feature: GZ8MTXP01BJD2G.21.47.E03.1.454.CMB.2.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcgagggtattaggcaacgtggttancctggtatcagcaaggaaaccaggaaaacncccctaaancctgatctatgctgcatccagttgcaaagtcggaccgtcccgtanaaggttccaggcggacnggtggggtctaggggacgtatttcaatctacacatcaccagcctgcaagtccagaagtatttcgacttaacgtttattatttacgacaaactacggtacttaacgttacgttttcccctctaccgtacggttccgggaacgggaacgggttaaccccgtaaagggttgggaaacggttaaccaaaacggttaccgttgggttcgggacccttaagacccgtacccgttagttccgttcgtttaaccc

SEQ ID NO: 305438 - DNA, 537 bp, Homo sapiens
  misc_feature: GZ8MTXP01AKF13.21.47.E03.1.454.CMB.2.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcgagggtattagcaacgtggttancctggtatcagcaagaaaaccaggaaaacncccctaaactcctagatctatgctgcatccagttgacaaagtcggactcccgtanaaggtcaggcgcnggtgggtctggggacgtatttcaatctacacatcaccagcctgcagcctagaactntttgactaacttattattgacaacgngtactaacttacgttttcctctacgtacggttcggcggaacggaccgtaacggttgggaacggtacaaacgacgttggtggctcgacaccttatcgttgttcc

SEQ ID NO: 305439 - DNA, 579 bp, Homo sapiens
  misc_feature: GZ8MTXP01D8Q03.21.47.E03.1.454.CMB.2.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttgcgggcagtcgagggttattagctaactggtagcctggtatcagcaagaaaccaggaaacncccctaaatcctagatctangctgcatcagttnacaaagtgaccgtccgtanaaggtcagcggntggtggtcgtgggacgtattacgaattctacactatcaaccagcccttggacagtccgtagaaacgttntttacgacttaaacgtttatttagttcgtacaacgtaggtaccttaacgttacgttttcctcgttaccgtacgggttcgggaacgggtaaggacccgtaaaggttggaacggtaacgaaaacgttcgttggtcggtctcggtcccaccgttattccgttcgttccc

SEQ ID NO: 305440 - DNA, 550 bp, Homo sapiens
  misc_feature: GZ8MTXP01EB5HI.21.47.E03.1.454.CMB.2.raw
  modified_base (200)..(200): a, c, t, g, unknown or other
  misc_feature (200)..(200): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
tcagtcgtcgctcgcacgaccggtgctcgatttagactcgcgcacagagagaaggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttgtcgggcgagtcagggtattagcaactggtagcctggtatcagcaagaaaccaggaaaacncccctaaatcctgatctatgctgcatccagttgacaaagtggactccgtanaaggttcagcgcnggtgggtctggggacgtatttcaatctcaccatcacagcctgcagcctgaagtattttagactaaactttatttattgtacaaactaggtacttaaactcgttttacctcttacgtacggtttcgggaacggtaacgggacctaaacgggttggaacggttacaaaacggttacttggtgggcctgccaccttatccgttgttaacc

SEQ ID NO: 305441 - DNA, 641 bp, Homo sapiens
  misc_feature: GZ8MTXP01EBXLX.21.47.E03.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagactcgcgcacagagagaagggggcaggagtcagacccagtcaggacacagcatggacatgagggtccccgctcagctcctgggctcctgctgctctggttcccaggttccagatgcgacatccagatgacccagtctccttcttccgtgtctgcatctgtagganacagagtcaccatcacttggcgggcagtagcctaaggggtattaaggcgtaaactcggttaagcctggtaatccaaggaccaaggaaaaacccaccggaaaaaacgccccctaaaagtcctacgaatcgtatgctagccatccacgtagcaaagtccggagtaccgttcaaggttccaaagcggcgaggtggggtacctaggggtacgatttcaaactctacaccatcaccagccctagcagacctagtaagtatttagactaaactttagttaacttagtacaaacctaggtacctttaaacctgttttccctacgttcggtaaccggttaacggaccgggttaacggggtaccttaaacgggtacggtaaacggttacgaaaacggttaccgttaagtacgggtaaccttacggacttaccctaagttccccgttaacg

SEQ ID NO: 305442 - DNA, 603 bp, Homo sapiens
  misc_feature: GZ8MTXP01DN3MN.21.47.E03.1.454.CMB.2.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagatcaccatcacttggtcgggcgagtcagggtattagctaacgtggttanctggtatcagacaagaaacaggaaaacnccccctaaatcctagatctatgctgcatccagttagacaaagtcggaccgtcccgtagtaaggtcaaggcggacaagggttgggtacgtaggggtaacgtatttacaatctacacatccaccacgcctcgacacgtacgtagaaacgttatttagaaccttaaagtttatttaagttacgtaacctaaacgtaggtacctttaaaccgttacgtttttccctacttaccgtacgggttccgggaacggtaacgggaacccgtaacggttggaacggtaacaaaacgttcgttgaaggtctcgacaccgattcgttcgttcc

SEQ ID NO: 305443 - DNA, 620 bp, Homo sapiens
  misc_feature: GZ8MTXP01BLTMG.21.47.E03.1.454.CMB.2.raw
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
tcagtcgtcgctcgcacgaccggtgctcgatttagactcgcgcacagagagaagggggcaggagtcagacccagtcaggacacagcatggacatgacgggtccccgctcagctccgtggggctcctgctgctctggttcccaggttccagatgcgacatccagatgacccagtcctccttcttccgtgtctgcatctggtagganacagatcaccatcacgttggcgggcgagtcgagggtatagctaacgtggtanctggtatcagacaagaaaccgaaggaaacgcccctaaactcctagatctatcgctgctactccagttagacgtaaaggtcggtacccgtcccgtagtaaggtcgacggccgggcgtgggttgggtcgtaggggacgttatttacaaacttcctaccacactaccacgacgcctgactacgtcgtagaacttagtttacgaccttaaactttatttagtacgtaaccaaacgacggttacttaaacgttcgttttccctcgttaccgtacgggttcggggaacggtacgggttaaccgtaacgggttagggaacggttacaaacggttcgttcggtggtctcgcctacgttattcgttcgttcc

SEQ ID NO: 305444 - DNA, 627 bp, Homo sapiens
  misc_feature: GZ8MTXP01BW9BN.21.47.E03.1.454.CMB.2.raw
  modified_base (289)..(289): a, c, t, g, unknown or other
  misc_feature (289)..(289): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgaaggggttattagcaacgtggttagcctggtatcagacaagaaaccaaggaaaacncccctaaatcctagatctatgctgactatccgtagttgacgtaaaggtcggaccgtcccgtagaaggttcaggcggctggtcgggtcgtggggacgtatttacatcctacactatcaccancctagcagtcctagaatntttacgacttaacgtttatttagttacgtaacaacgtaaggtaccttaacgttacgtttttccctcgttaccgtaccgggttcgggaacggggtaacggttaaacccgtaaacgggttacggaaacgggttaaccgaaaaacggttccgttgggtaacggacctcggtacctaacccttagttcccgtttgtttaaccc

SEQ ID NO: 305445 - DNA, 588 bp, Homo sapiens
  misc_feature: GZ8MTXP01A7NVD.21.47.E03.1.454.CMB.2.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (554)..(554): a, c, t, g, unknown or other
  misc_feature (554)..(554): n is a, c, g, or t
  modified_base (563)..(563): a, c, t, g, unknown or other
  misc_feature (563)..(563): n is a, c, g, or t
tcagtcgtcgctcgcacgaccggtgctcgatttagactcgcgcacagagagaagggggcaggagtcagacccagtcaggacacagcatggacatgagggtcccgctcagctcctgggctcctgctgctctggttcccaggttccagatgcgacatccagatgacccagtctccttcttccgtgtctgcatctgtagganacagagtcaccatcacgttgtcgggcgagtcgaagggtattagctaacgtggttancctggtatcaagcaaggaaaccaaggaaaaccgtcccctaaatccgtagatctatgactgacactccagttcgacaaagtcggtaccgttcccgtagtaaggtcacggtacggacgtaaggtgggtccgtaggggacgtattacgaatctacacatcacacgctacgcagcctagaacgttatttcgaactaatttattacttacgacaaacgtcgtacttaacttacgtttcctactacgtaccgttcggggaacggtacggttaaccgtaaggttcgggaacgtacgaaacgttcgnggttaacgnttcgactacttatcgttcgttaacc

SEQ ID NO: 305446 - DNA, 527 bp, Homo sapiens
  misc_feature: GZ8MTXP01BL7UZ.21.47.E03.1.454.CMB.2.raw
  modified_base (177)..(177): a, c, t, g, unknown or other
  misc_feature (177)..(177): n is a, c, g, or t
  modified_base (249)..(249): a, c, t, g, unknown or other
  misc_feature (249)..(249): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (455)..(455): a, c, t, g, unknown or other
  misc_feature (455)..(455): n is a, c, g, or t
  modified_base (512)..(512): a, c, t, g, unknown or other
  misc_feature (512)..(512): n is a, c, g, or t
tcagtcgtcgctcgcacgaccggtgctcgatttagactcgcgcacagagagaaggggcaggagtcagacccagtcaggacacagcatggacatgagggtccccgctcagctcctggggctcctgctgctctggttcccaggttccagatgcgacatccagatgacccagtctccttnttccgtgtctgcatctgtaggagacagagtcaccatcacttgtcgggcagtcagggtatagcaactggttanctggtatcagcaagaaaccaggaaaacgcccctaaatcctgatctatgctgcatccagttgacaaagtgacgtcccgtnaaggttcagcggcngtgggtctggggacgtatttcaatctcaccatcgaccagcctgcacgcctagtaagtattttagacctaagtttatttaagttgtacaacaggtctaaactacgttttccctntcgacggtttcggcggaggacctaacggttggaacggttcaaacgacttggtgtccngcacttctcgttgtc

SEQ ID NO: 305447 - DNA, 752 bp, Homo sapiens
  misc_feature: GZ8MTXP01CVEVD.21.47.E03.1.454.CMB.2.raw
  modified_base (266)..(266): a, c, t, g, unknown or other
  misc_feature (266)..(266): n is a, c, g, or t
tcagtcgtcgctcgcacgaccggtgctcgatttagactcgcgcacagagagaagggggcaggagtcagacccagtcaggacacagcatggacatgagggtccccgctcagctccgtggggctcctgctgctctggttcccaggttccagatgcgacatccagatcgacccagtcctccttcttccgtgtctgctatcgtgtaggagacagacgtccaccatctacgttggtcgggcgtagtcgagggtattagctaagttggttancctggtatcgagacaaacggaaaccaaggaaaacctacccccttaaacgtcctagtactactatcgaccttgacctacgtaccgtacgttacgaaccgtaaaggttcggaccccgttacccccggtagtaacgggttcgaacggtaccgggtactaaggggttcggggttccgagggggttacgtactttaccgaaactcccgtaccaacctactaccaccgtacgtccgtacgaccgtaacgtcccgttaaggtaacgtttacgttttacgtaactttaaacttttaagtttacgtttacaaaccgtaacgtacgttaacctttaaacgtttcctttttcccgtaccgttacggttaccgggttccgggaacggggtaaacggttacccggtaaacgggttacgggtaaaccggtaacgttaaaaccggttcgttacgggtcgtaccgtaacggaccctacttacgtttccgttcgtttaacccg

SEQ ID NO: 305448 - DNA, 571 bp, Homo sapiens
  misc_feature: GZ8MTXP01CUR1M.21.47.E03.1.454.CMB.2.raw
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcaggggttattagcaacgttggttancctggtatcagacaagaaaccaggaaacncccctaaactcctagatctatgctgacatccagttgacaaagtggacctcccgtanaaggtcagcgggactgggtgggtctagggggtacgtaatttcaaatcctaccaacctataccaccacgccctaggccagtcctagaaacgtattttagaccttaatttattattcgtacaaanacgtactaatacgtttcnctacgacgtcggaacgaacgggaccaacggttggaaacggtacaaaacggttcgttgtggacttgacctaccttattccttaagttcc

SEQ ID NO: 305449 - DNA, 631 bp, Homo sapiens
  misc_feature: GZ8MTXP01BDLXL.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgagggtatagctaacgtggttagcctaggtatcagacaagaaaccaaggaaaaccgtccccctaaactcctagactctatcgctgactactccacgttgacgtaaagtcggtacccgtcccggtagtaaggttcaggtcggacgtaagggtgggtaccgtaggggtacgtatttacaaacgttccctacaaccactacccaccgacgtccctagcctaacgcccttaagaagttatttacgaaccttaacgttttatttaagttcgtaacctaaacgtacggttaccttaaaccgttacgtttttccctcgttaccgtaccggttcgggaacggtacgggacctaacggttggtaacgtacaaacgcgttggtcggctcgactacgattcgttgttccc

SEQ ID NO: 305450 - DNA, 701 bp, Homo sapiens
  misc_feature: GZ8MTXP01ASK1Y.21.47.E03.1.454.CMB.2.raw
  modified_base (285)..(285): a, c, t, g, unknown or other
  misc_feature (285)..(285): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcaagggtattagcaacgtggttagcctggtatcagacaagaaaccaggaaaacncccctaaatcctgatctatgctgctaactccgtagttgaacaaaggtcggaacccgtccccgtagaaggttcaggccgggcgtaaggtggggtaccgtaggggacggttatttaccgaaagttcctaccaacctaactaccaaccgacgtcccttaggcctaacgtccctaggtaaagttacttttacgaccttaaactttagtttaactttacggtaacctaaacgtaacggttacttaaaccgtttacggtttttaccccttacgttacccggttaaccggggttcccgggggaacgggtaaaccgggggttaaacccgtaaacggggttagggtaaaccgggttaacaaaaaccgggttacgttcgggttaacggcgttaacggacctacccgttattccgttaacggttccc

SEQ ID NO: 305451 - DNA, 594 bp, Homo sapiens
  misc_feature: GZ8MTXP01AL4M1.21.47.E03.1.454.CMB.2.raw
  modified_base (337)..(337): a, c, t, g, unknown or other
  misc_feature (337)..(337): n is a, c, g, or t
tcagtcgtcgctcgcacgaccggtgctcgatttagactcgcgcacaaagagaagggggcaggagtcagacccagtcaggacacagcatggacatgagggtccccgctcagctcctggggctcctgctgctctggttcccaggttccagatgcgacatccagatgacccagtctccttcttctgtgtctgcatctgtaggagacagagtcaccatcacttgtcgggcgagtcagggtattagcaactggttagcctggtatcagcagaaaccaggaaaacgcccctaaactcctgactctatgctgcatccacgttgacaaagtcggacgtcccgtanaaggttcagtcggcaaggtgggtctggggacggtatttcaatcctacacctatcaccagcctgcagcctagaagtatttacgactaaacgtttattaactttcgaactaacgtacgtaaccttaacgtttaccgtttccctctaccggttacggttccggggaacgggtaaccgggttaaccgtacgggttacgggtaacgtaacgaaaccggttgttcggtaacgtcaacggtccaccttattccgttcgtttccc

SEQ ID NO: 305452 - DNA, 647 bp, Homo sapiens
  misc_feature: GZ8MTXP01A6M16.21.47.E03.1.454.CMB.2.raw
  modified_base (203)..(203): a, c, t, g, unknown or other
  misc_feature (203)..(203): n is a, c, g, or t
tcagtcgtcgctcgcacgaccggtgctcgatttagactcgcgcacagagagaagggggcaggagtcagacccagtcaggacacagcatggacatgacgggtccccgctcagctcctggggctcctgctgctctggttcccaggttccagatgcgacatccagatgacccagtcctccttcttccgtgtctgcatctgtagganacagacgtcaccatcacttggtcgggcgagtcgagggtattagctaagttggttacgccgtggtatcagacaaggaaaccaacggaaaacgacccctaaactcctagtatctatcgctgctactccgacgttgacgtaaaggtcggtacccgtacccgtagtaaacggttcacggtccggtacgtaagggttcggggtacgtaggggtacggttatttacgaacttcctaccactactaccgaccgcgtacctcgactacgacgtagtaagttacgtttacgaccttaagtttattattcgactaagtcgtacttacttacgtttcctccgttcgtacggttcgggaacggtaacgggaccgtaacggttaggtaacggtaacaaaccggttcgttaggttaacggccgttcggacctaccgttacttccgttcgtttaacccg

SEQ ID NO: 305453 - DNA, 550 bp, Homo sapiens
  misc_feature: GZ8MTXP01B1TWP.21.47.E03.1.454.CMB.2.raw
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
  modified_base (418)..(418): a, c, t, g, unknown or other
  misc_feature (418)..(418): n is a, c, g, or t
  modified_base (531)..(531): a, c, t, g, unknown or other
  misc_feature (531)..(531): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttggtcgggcagtcagggtatagcaactggtancctggtatcagcaagaaaccaggaaaacgcccctaaactcctagatctatgctgcatccagttgactaaagtggaccgtccgtacgaaggttcagtcggcaaggtgggtcgtggggacggtatttcaatctacacatacaccagacctgcagcctagaacgtatttanactaagtttaattattgtacaactaggtactaactacgtttcctctctaccggttggcgggaaggaccgtaacggttaggtacggtaacaaacggttaacttcggttggcgtnaccaccttatccttgttcc

SEQ ID NO: 305454 - DNA, 821 bp, Homo sapiens
  misc_feature: GZ8MTXP01AJ6UQ.21.47.E03.1.454.CMB.2.raw
  modified_base (229)..(229): a, c, t, g, unknown or other
  misc_feature (229)..(229): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttccccaggttccagatgcgacatccagatgacccagtctccttcttccgtgtctgcattctgtaggagacagagtcaccatcacttggtcgggnagtcagggttattagctaacgtggttagcctggtatcgagacaagaaaccgaggaaaaccgcccctaaatcctagatctatcgctcgctacttccgtaggttacacgtaaaaggtcggtacccgtttaccccccggtataaacggggtttccaagggcccgggtaccgtaaggggttcggggtaccgtaggggggtaaccgttactttttacgaaactttccctaccctaaccgtaaccttaccgtaaccccgtaaggccccgttaacgggcccgaaccgggtaccccgtttaagggtaaacgtttacgtttttaccgtaaaccgttaaaaccgtttttactttaaacggttttccgtaaaccgtaaaccgttaaccgggtaccctttaaaaccgtttacccggttttttccccaccgtttacccggtaaccggggtttccgggaaacccgggggtaacgggttaaaccccgtaaaccggggttaggggtaaaaccgggttaacccgaaaaccgggttaacgttcggggcccgggtaactttaacccgggaaccctaccccggtttaagttccctttaacgggttttccccg

SEQ ID NO: 305455 - DNA, 639 bp, Homo sapiens
  misc_feature: GZ8MTXP01A4PUW.21.47.E03.1.454.CMB.2.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcaccatcacttggcgggcgagtcagggtattagcaacgtggttanctggtatcagcaagaaaccaggaaaacncccctaaatcctagatctatgctgcatccgagttnacgtaagtgccgtccgtagaaggtcagcggcnggtgggtcgtagggacgtatttacatctacacatcaccagcctagacagtacctagtaagtactttacgacttaacgtttattagttacgactaaacgtaggtaaccttaacgttacttttcccgtccgttaccggtaaccggtttccgggggaaccggggttaacgggttaaaccccgggtaaacgggtttagggaaacgggttaaaccgttaaaaaacgggttaccggttggggtaacggtacccgttaacggaccctacccggttattccgttaaccggtttaaccc

SEQ ID NO: 305456 - DNA, 681 bp, Homo sapiens
  misc_feature: GZ8MTXP01EW6MQ.21.47.E03.1.454.CMB.2.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagatcaccatcacttggtcgggcgtagtcagggtatagcaacgtggttancctggtatcagcaacgaaacaggaaaacncccctaaatcctagatctatcgctgaccatccagttagactaaaggtcggaccgtcccgtanaaggttcaggccggcgtaaggtcggggtacgtagggggacgttatttcgaaattcctacaacctatcccaaccacgtcccgtagacacgtaccctaggtaaacgtattttacgaaccttaaacgttttaatttaacgtttagtaaccgtaaaaccgtacgggtaccttttaaaacgttccggttttttccctacgtttacccgtaacgggtttccgggggaaccgggtaaaaccggggttaccggtaaaccgggttgggaaaccgggtttaaaccaaaacgggttacgttcgggaacggtccgttaacggccaaaccttggttccttggtttaaccc

SEQ ID NO: 305457 - DNA, 671 bp, Homo sapiens
  misc_feature: GZ8MTXP01B5D9F.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtccttccttcttccgtgtctgcatctgtaggagacagagtcaccatctacgttggcgggcgagtcgaaggggttattaggactaacgtggttacgcctggtatacgagacaaaggaaaacccgaaggaaaaccgtccccctaaaactcctagactctatgctgctactccagttgacaaaggtcggaccgtccgtagaaggtcaggcgcgtaagggtgggtacgtaggggtacgtatttacatcctacaacctactccaaccagtcccgtagaccgaacgtccgtaagtaaagttatttttacgaacctttaaacggttttaatttagttacgtaaccaaacgttaggtaccttaacgtttacggtttttccctaccgttaccggtaaccgggttcggggaaccggggtaacggttaaccgtaaacgggttacgggaaacgtaaccgttaaaacggttcgttggtaacggtcgtcgaccgtacttacttcgttcgtttccc

SEQ ID NO: 305458 - DNA, 617 bp, Homo sapiens
  misc_feature: GZ8MTXP01D1385.21.47.E03.1.454.CMB.2.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (351)..(352): a, c, t, g, unknown or other
  misc_feature (351)..(352): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgaccccagtcctccttcttccgtgtctgcatctgtagganacagatcacatcattggtcgggcagtcgagggttatagctaagtggtancctggtatcagacaagaaaccaaggaaaacncccctaaaatcctagatctatgctgctactccagttnacgaaagtcgacctccgtanaaggtcagcgnnggtgggtcngggactattcaatctacacataccacagccctagcacgtcctagaattgtttanaccttaagtttattagttacgaacctaaacgtacgtacctttaaacgttcgttttaccctcgttaaccgtcgggttcgggaaccgggtaacgggttaacccgtaaacgggttgggtaaaccggttaacgaaaaaccccggttgttacgggtaacgggtaccccttgggaacccctacttacgttccgttaacgttaaccccg

SEQ ID NO: 305459 - DNA, 598 bp, Homo sapiens
  misc_feature: GZ8MTXP01D0087.21.47.E03.1.454.CMB.2.raw
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (430)..(430): a, c, t, g, unknown or other
  misc_feature (430)..(430): n is a, c, g, or t
  modified_base (491)..(491): a, c, t, g, unknown or other
  misc_feature (491)..(491): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtccttccttcttccgtgtctgcatctgtaggagacagacgtcacctatcacgttggtcgggcgagtcagggtattagcaactggtanctgtatcagacaagaaaccaggaaacncccctaaatcctgatctatgctgactatccagttgactaaagtcggaccgtcccgtataaggttcaggccggtataagggtgggtacgtaggggtacgtatttcgaatcctacacactcaccagtcctgactacgcctagaaattntttacgaaccttaagtttattagttagaacctaaacgtgtaccttaaattaccgttttccnccgttacgtcgggttccgggaacggtaacggttaccgtacggttaggtaacgtaaccgaaacgttcgttggtcgcttaacgcctacttacgttctttaacgtaaccg

SEQ ID NO: 305460 - DNA, 536 bp, Homo sapiens
  misc_feature: GZ8MTXP01CGBQC.21.47.E03.1.454.CMB.2.raw
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
tcagtcgtcgctcgcacgaccggtgctcgatttagactcgcgcacagagagaaggggcaggagtcagacccagtcaggacacagcatggacatgagggtccccgctcagctcctgggctcctgctgctctggttcccaggttccagatgcgacatccagatgacccagtctccttcttccgtgtctgcatctgtaggagacagagtcaccatcacttggtcgggcgagtcagggtattagcaacgtggttancctggtatcagcaagaaacccaggaaaacncccctaaatcctgactctatgctgcatccagttgacaagtggactcccgtnaagtcagcgctggtgggtctggggacgtattcaatcctcaccntccaccagcctgcagctanagtntttnactaactttattattcgactaacgtagtccttaacttcgttttccctcttcgtacggtcgggcggaacgggttacaacgggttgggtaacgtcgaaacgcgttcggtcgcgtgacaccttagtcgttcgttcc

SEQ ID NO: 305461 - DNA, 685 bp, Homo sapiens
  misc_feature: GZ8MTXP01ELG5M.21.47.E03.1.454.CMB.2.raw
  modified_base (203)..(203): a, c, t, g, unknown or other
  misc_feature (203)..(203): n is a, c, g, or t
  modified_base (660)..(660): a, c, t, g, unknown or other
  misc_feature (660)..(660): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtccttccttcttccgtgtctgcatctgtagganacagagtcacctatcacgttggtcgggctagtcgagggttattagctaacgtggttacgcctaggtatacgagacaacgaaaccgaaggaaaacctccccctaaatcctagactctatgctgctatccctagttcgacgtaaaggtcggtacccgtccccggtataaagggttccacgggccgggtactaaggggttcggggttaccgtacgggggtaacgttacttttacgaaactttcccgtacctaacctacgtacccacccgacggtcccttacggacctaggtacccgtagtaaacgttattttacgaaccttaaacgttttaatttacgtttacgtacaaacgtacgtaccttaaacttacgttttccctacgttaccgtacggttccgggaacgggtaaccggaccgtaacggttaggaaccggttaacaaaacggttgttcggtcggtntaacgtcacgttacttcttcgttcc

SEQ ID NO: 305462 - DNA, 763 bp, Homo sapiens
  misc_feature: GZ8MTXP01AJIS7.21.47.E03.1.454.CMB.2.raw
  modified_base (287)..(287): a, c, t, g, unknown or other
  misc_feature (287)..(287): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacgttggtcgggcgagtcgagggttatagctaagtggtagcctggtatcagacaagaaaccgaaggaaaacncccctaaatcctagatctatcgctgctatccagttgacgtaaaggtcggacccgttaccgtacgtaaaggttccgaggtcgggtacgtaaggggtcgggtaccgtagggggtaacgttatttacgaaacttcccactaaccctactacccaccgtaacggcctacggacgtacggtacccttagggtaaacgtttacgttttacgtaaccctttaaacttttaaggttttaagtttaccgttaaaccgtaaacccgttaaacggggttaaacccttttaaaacccggtttaaacccggttttttttccctaacccggtttaacccgggttacccggggtttcccggggggaaccggggtaaaccggggttaaaccccggtaaaccggggttagggtaaaacccgggtaacgttaaaaccgttacgggttcgggtaacgtacgtccgaaccgtcttacgttccgttcggtttaaccg

SEQ ID NO: 305463 - DNA, 583 bp, Homo sapiens
  misc_feature: GZ8MTXP01BB0AN.21.47.E03.1.454.CMB.2.raw
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
  modified_base (346)..(347): a, c, t, g, unknown or other
  misc_feature (346)..(347): n is a, c, g, or t
  modified_base (378)..(378): a, c, t, g, unknown or other
  misc_feature (378)..(378): n is a, c, g, or t
  modified_base (403)..(403): a, c, t, g, unknown or other
  misc_feature (403)..(403): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcattggtcgggcgagtcagggtattagcaatggttagcctggtatcagacaagaaaccaggaaaacncccctaaatcctagatctatgctgcatccagttgacaaagtgaccgtccgtanaaggtcaggcgnngtgggtctagggacgtatttcaatccacacntcacagcctgcagcctagaacgttntttacgacttaacgtttattattcgacctaaagtccggtacttaacgttacgttttcctacgttacctacgggttccgggcggtaacggggaccctaacggggttggtaaacggtaacttaaaacgggccgttagggtccggacttcggaaccaccttacgttccgttaacgtttaaccc

SEQ ID NO: 305464 - DNA, 695 bp, Homo sapiens
  misc_feature: GZ8MTXP01ESM7N.21.47.E03.1.454.CMB.2.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (647)..(647): a, c, t, g, unknown or other
  misc_feature (647)..(647): n is a, c, g, or t
tcagtcgtcgctcgcacgaccggtgctcgatttagactcgcgcacagagagaagggggcaggagtcagacccagtcaggacacagcatggacatgagggtccccgctcagctcctgggctcctgctgctctggttcccaggttccagatgcgacatccagatgacccagtcctccttcttccgtgtctgcatctagtaggagacagactcaccatcagttggtcgggctagtcgaggtatagactaacgtggtanctggtancagacaagaaaccaaggaaacacccctaaatcctagattctatgtctgacctatccgagttgaacgtaaaggtcggtacccgtcccgtagtaacgggttcacggcggacgtgggttgggtccggtaggggtacgtatttaccgaaattccgtaccacctacgtaccaaccgtatccccgttagacctaacgtccgtaaggttaaacgtttacgtttaacgacctttaaacgtttttaagttaacgttaccggttaaaccaaaacgtcggtaaccctttaacgttacccgtttttcccgtaccgttaccggtaccggttacggggaacgggttaaccgggttaaacccgtaagggttcggtaaacccggttaacaaaaccgggttnttcgggtaacgtccgtcgacctaaccgttcttcttaaccggttaaccc

SEQ ID NO: 305465 - DNA, 683 bp, Homo sapiens
  misc_feature: GZ8MTXP01EA4L9.21.47.E03.1.454.CMB.2.raw
  modified_base (668)..(668): a, c, t, g, unknown or other
  misc_feature (668)..(668): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtccttccttcttccgtgtctgcatctgtaggagacagagtcaccatcacgttggtcgggcgagtcgaaggggttattagctaacgttggttaacgcctaggtactcgaagaccaacggaaaacccgaagggaaaaacctccccctaaaactcctagaattctatgctgcctatccgagttgacgtaaaggtcggtacccgtcccggtagtaaggttcgacggccgggacgtgggttcgggtaccgtaggggtacgtatttacgaaacttcctaccgaacctactccgaccgtacgcctagacctagtccgtagtaaacgttatttacgacttaaacgtttactttacgttacgtaaccgtaaacgtacggttacctttaacgttaccgttttcccgtaccgttaccggtaccgggttccggggaacgggtaacggttaaccgtaagggttcgggtaaacgtacgaaacggttcgttgcggtctaaggcctaaccgttnttcgttcgttaaccg

SEQ ID NO: 305466 - DNA, 944 bp, Homo sapiens
  misc_feature: GZ8MTXP01CGM2I.21.47.E03.1.454.CMB.2.raw
tcagtcgtcgctcgcacgaccggtgctcgatttagactcgcgcacagagagaagggggcaggagtcagacccagtcaggacacagcatggacatggagggtccccgctcagctcctggggctcctgctgctctggttcccaggttccagatgcgacatccagatgacccagtcctccttcttccgtgtctgcatctgtaggagacagagtcaccatctacgttggtcgggcgtagtacgtaggggttataggactaacgttggttacgtccgtggtactcgagacaacggaaaccgaaacggaaaaccgtaccccctaaaactcctaggtaacttacgtatcgtacctacgtacccgtaacttaccccgtaacggtttacgaaccggtaaaagggttcggggtaaacccccggttcccccggtaacgtaaacggggtttcccgacgggtaacccggggtaacgttaacgggggttcgggggttaccgggttacggggggttaaccgggttaacttttaacccgtaaacgttccccgttaaccctaacccgtaactccccgtaaacccggtccgtcccgttacgggaccctaaccgggtacccgttaaaggtaaaccgttttacgtttttacggtaaacccttttaaactttttaaagttttaacggttttaacgtaaacccggtaaaacgttaaaccgggtttaacccttttaaaccggttttaccgtttttttacccctacccgggtttaaccccggttaacccgggggttttacccgggggaacccgggggttaaaaccgggggttacccgtaaaaacgggggtttacggggtaaaccgggttaaacccggttaaaacccggttacccggtttggggttaaccgggccctttaaccgggacccctttaaccgttacgggttttaaccttccggtttttcccc

SEQ ID NO: 305467 - DNA, 670 bp, Homo sapiens
  misc_feature: GZ8MTXP01B42PX.21.47.E03.1.454.CMB.2.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgaccccagtcctccttcttccgtgtctgcatctgtagganacagagtccaccatcacttggtcgggcgagtcgagggtatagcaagtggtanctggtancagacaagaaacaggaaaaccncccctaaatctagatctatcgctgcatccgagttgaactaaaggtcggaccgttccccgtagtaacggtcagggcggcgtaaggggtcggggtcgtgggggtaacgttatttacgaaacttcccacctaaccacgtacccaccgtaacgtcccgtaagccgtacgtccgtaagtaaacgttattttacgaactttaacgttttatttaacgttacgtaccaaacgtacgtacctttaacttacgttttccctcgttacgtaccgggttcggggaacgggtaaccggttaaccgtaacgggttacgggtaaaccgttaacggaaaaccggttcgttcgggtccggtacctaacggtaccctacccgttattccgtttcgtttaaccg

SEQ ID NO: 305468 - DNA, 637 bp, Homo sapiens
  misc_feature: GZ8MTXP01D5K8I.21.47.E03.1.454.CMB.2.raw
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (610)..(610): a, c, t, g, unknown or other
  misc_feature (610)..(610): n is a, c, g, or t
  modified_base (620)..(620): a, c, t, g, unknown or other
  misc_feature (620)..(620): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtccttccttcttccgtgtctgcatctgtaggagacagagtcaccatcacttggtcgggcgagtcgagggttatagcaagtggtanctggtatcagacaagaaaccaggaaacncccctaaatcctgatctatcgctgctactccagttgacgtaaaggtcggtaccgtcccgtagtaaggttcaggcgggcgtaagggtgggtacgtaggggtacgtatttacgaacttcctacaaccataccaacccgtacggtaccctacggacctacggtacccgttaaggtaaaacgtttactttttaacgaaccctttaaacgttttaaatttacgtttacggtaacctaaacgtacggtaccttaaacgttacgttttccctcgttacgtacgggttcgggaacggtagggacctacgggttagacgtaacaaacgttcgttgnggtctcgacncttacgttcttcgttcc

SEQ ID NO: 305469 - DNA, 676 bp, Homo sapiens
  misc_feature: GZ8MTXP01B1WKO.21.47.E03.1.454.CMB.2.raw
  modified_base (228)..(228): a, c, t, g, unknown or other
  misc_feature (228)..(228): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatcgacccagtcctccttcttccgtgtctgcatctgtaggagacagagtcaccatcattggtcgggngagtcgagggttatagctaacgtggtagctggtatcagacaagaaaccaggaaaacctcccctaaactcctagacttctatgtactgacctactccgtacgttcgacgtaaaggtcggtaaccgtccccggtagtaagggttccgaggccgggtacgtgggttcggggtccgtaggggtaacgttatttacgaaacttcctaccaacctactaccgaccgacgtcctacgccacgtacctaggtaaacttcgtttacgacttaaacgtttattaaggtttacaaccgtaaacgtacggtacctttaaaccgtttacggttttccctccgttaccgttaacggggtttccgggaaccggggtaacggttaacccgtaaacgggttggaaacggttaccgaaacggttacttgggtaacggtctcgaccacttacgttccgttcgttaac

SEQ ID NO: 305470 - DNA, 758 bp, Homo sapiens
  misc_feature: GZ8MTXP01C0M4Z.21.47.E03.1.454.CMB.2.raw
  modified_base (292)..(292): a, c, t, g, unknown or other
  misc_feature (292)..(292): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcttcttcttccgtgtctgcatctgtaggagacagatcaccatcacttggtcgggcgagtcgaagggttattagactaacgtggtagcctaggtatcaagacaaacgaaaccaaggaaaacncccctaaaatcctagtatctatcgctgactactcctagttacgaacgtaaaggtcggtaacccgttccccggtaacgtaaagggttcgaacggtaccgggtacggtaaggggttacggggttcggtaaacgggggtaaccggttaactttaacggaaactcccgttaaccaacctaactaccaaacccgtacggacccttacggaccgaacgtacccgtaagttaaaacgtttactttaaccgtaaactttaaacgttttaacgtttaacgttaaccgtaaccgtaaacgtaacgttaaccttaaacgtttaccgttttcccgtaccgttaccggtaaccggggttacggggaaccgggtaaaccgggttaaaccggtaaacgggttaacgggtaaacggtaaacgttaaaacggttacgttacggtaacggtactaacgacctaacttacgtttcgttcgttaac

SEQ ID NO: 305471 - DNA, 649 bp, Homo sapiens
  misc_feature: GZ8MTXP01BJ98S.21.47.E03.1.454.CMB.2.raw
  modified_base (326)..(326): a, c, t, g, unknown or other
  misc_feature (326)..(326): n is a, c, g, or t
tcagtcgtcgctcgcacgaccggtgctcgatttagactcgcgcacagagagaagggggcaggagtcagacccagtcaggacacagcatggacatgaggactccccgctcagctcctggggctcctgctgctctggttcccaggttccagatgcgacatccagatcgacccagtcctccttcttccgtgtctgcatctgtagagacagatcacatcacttgcgggcgagtcgagggtattagacaacgtggtacgctggtatcagcaacgaaaccgaggaaaaccgcccctaaactcctagactctatcgctgactactcctagttnacgtaaaggtccggacgtccgtagtaaggtcgaaggccggcgtagggtcgggtcgtaggggtacgtactttacgaactctacaccataccaccgacgccctgactacgtaccgtagtaaacgttagttttacgaacttaactttaagttacgttacgtaaccgtaacacggttaccttaaacgttccgtttttacccgtcttaccggtaaccgggttccgggaaccgggttaacggggtaaaccccgttagggttaacgggaacgggttaaaccgttaacggttaacgtgggtcggcgtacggccttaactcgttcttaaccg

SEQ ID NO: 305472 - DNA, 576 bp, Homo sapiens
  misc_feature: GZ8MTXP01E0SYF.21.47.E03.1.454.CMB.2.raw
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagagacagagtcaccatcacttgtcgggcagtcagggtattagctaactggttacnctggtatcagcaagaaaccaggaaaacncccctaaatcctgatctatgctgcatccagttgacaaagtgacgtccgtanaagttcagcgcnggtcgggtcgtagggacgtatttcgaaattcctacaccatccgaaccagcctgacaggcctagaacgttntttagacctaacgtttattattgtacaaacgtggtacttaactacgttttcctacttccgtacggttcgggaacgggtaacggaaccgtaaacggttgggaaacgtacaaaacggttacgttaggtcgggtctcggacctaccgttacttccgttgttaaccc

SEQ ID NO: 305473 - DNA, 767 bp, Homo sapiens
  misc_feature: GZ8MTXP01AQD5C.21.47.E03.1.454.CMB.2.raw
  modified_base (186)..(186): a, c, t, g, unknown or other
  misc_feature (186)..(186): n is a, c, g, or t
  modified_base (258)..(258): a, c, t, g, unknown or other
  misc_feature (258)..(258): n is a, c, g, or t
  modified_base (725)..(725): a, c, t, g, unknown or other
  misc_feature (725)..(725): n is a, c, g, or t
tcagtcgtcgctcgcacgaccggtgctcgatttagactcgcgcacagagagaagggggcaggagtcagacccagtcaggacacagcatggacatgagggtccccgctcagctccgtggggctcctgctgctctggttcccaggttccagatgcgacatccagatgacccagtctccttcttccgtntctgcatctgtaggagacagatcacctatcacgttggtcgggcgagtcgagggtattagctaacgtggttanccgtaggtatcgagacaacgaaaaccaagggaaaacctaccccctaaactcctagtacttactaagtcgactggacctaacgttacccgtaacggtttacgaaccgtaaaagggttcggggtaaccccgttacccccggtaaggtaaacgggtttaccgacgggtacccgggtccgtaagggggtttccgggggttaccggttacggggggaaccggtttacgtttttacccgaaaatttccccgttaacccaaaccgtaccctaccgaacccccggtaaggtcccccgttagacccgtacggtacccgttaaaggtaacgtttaacgttttacgaacctttaaaggtttaatttacgttacggtacctaaacgacggtaacttaaccgttacgttttccctacgtacgtacggttcgggaacggtaccggttacgtacggttggtaaaccgtaacaaaccgggttnttagggtgacttgacccgtaccttagttccgttgtttaaccc

SEQ ID NO: 305474 - DNA, 593 bp, Homo sapiens
  misc_feature: GZ8MTXP01A1XJ8.21.47.E03.1.454.CMB.2.raw
  modified_base (202)..(202): a, c, t, g, unknown or other
  misc_feature (202)..(202): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (407)..(407): a, c, t, g, unknown or other
  misc_feature (407)..(407): n is a, c, g, or t
tcagtcgtcgctcgcacgaccggtgctcgatttagactcgcgcacagaaagaagggggcaggagtcagacccagtcaggacacagcatggacatgagggtccccgctcagctcctggggctcctgctgctctggttcccaggttccagatgcgacatccagatcgacccagtctccttcttccgtgtctgcatctgtagganacagatcaccatcacttgtcgggcgagtcagggtattagcaactggtagcctgatcagcagaaaccaggaaacncccctaatctgatntatgctgcatccacgttgacaagtggacgtcccccgtagaggttcaggcggaacaggtgggtcgtaggggacgtagttcaatcacacatccacacgcctgacacgcctagtaacgtntttacgaccttaattagtttattacggtaccaaacgtacgtacttaaacgttcgttttaccctcgtccgtaaccggttcgggcggggtaacggtaacgttaaccgggtaggaacggttaccgaaaacgttaaccgttggttcgggtaaccttcggaaccgacctagttccgtcgttaacctttccc

SEQ ID NO: 305475 - DNA, 604 bp, Homo sapiens
  misc_feature: GZ8MTXP01BR8PB.21.47.E03.1.454.CMB.2.raw
  modified_base (252)..(252): a, c, t, g, unknown or other
  misc_feature (252)..(252): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtaggagacagacgtcaccatctacttggtcgggcagtcgagggtatagctaatggtanctggatcgagacaagaaaccaaggaaaactcccctaaatcctagactctatgctgactactaccgtagttcgaacaaaggtcggaccgtccgtanaggtcaggcgntggtggtacgngggacgtnttcaatcacacctnacacagtcctagctagaccgtagtaattntttcgaacttaatttattacgtcgtacgtaaagtcggtaacttaacgttcgttttccctcgtaccgtacgggttccggggaacggtacgggttaacccgtaaacggggttcggtaaacggtaacccgttaaaacgcgtttacggcggttacaacgtccgtaacgttcttcgtttaaccgtttcc

SEQ ID NO: 305476 - DNA, 598 bp, Homo sapiens
  misc_feature: GZ8MTXP01D0LJL.21.47.E03.1.454.CMB.2.raw
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgaccccagttccttcccttcttccgtgtctgcatctggtagganacagacgtcacctatcacttggtcgggcgagtcgagggttatagcaacgtggttagctggtatcagacaagaaaccaggaaacncccctaaatcctnatctatnctncatcagttgacaagtcgacgtccgtanaagtcagcgactgggtgggtctaggggacgtattcattctacactatccaccacgtcctgacgacgccgttaggaaacgttagtttttacgaacctttaaacgtttaatttaagttacgtactaaacgtacgtaacctttaacgttaccgttttctccgtaccgtacgggttccgggtaacggggtacggttaccgtaaggttacgggacggtaacgaaaacggttagttggtgctgactacgattcttaacgtttc

SEQ ID NO: 305477 - DNA, 593 bp, Homo sapiens
  misc_feature: GZ8MTXP01A86SU.21.47.E03.1.454.CMB.2.raw
  modified_base (256)..(256): a, c, t, g, unknown or other
  misc_feature (256)..(256): n is a, c, g, or t
  modified_base (426)..(426): a, c, t, g, unknown or other
  misc_feature (426)..(426): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgagggtattagcaacgtggttacncctggtatcagcaagaaaccaggaaacgcccctaaatcctagatctatgctgctactccagttgactaaaggtcggtaccgtcccgtagaaggttcaggtcggctgggtgggtcgtggggacgtatttacaattcctcaaccatcaccagcctagccagtcctagaagtntttacgacttaactttattattgactaaacgtcggtacttaaacgttacgttttccctacgttaccgtaccgggttccgggaacgggtaacggggaccctaaagggttaggtaacgggtaacaaaacgttcgttaggtcgggctcgacctacttctcgttgttaacc

SEQ ID NO: 305478 - DNA, 842 bp, Homo sapiens
  misc_feature: GZ8MTXP01AY08D.21.47.E03.1.454.CMB.2.raw
  modified_base (800)..(800): a, c, t, g, unknown or other
  misc_feature (800)..(800): n is a, c, g, or t
tcagtcgtcgctcgcacgaccggtgctcgatttagactcgcgcacagagagaagggggcaggagtcagacccagtcaggacacagcatggacatgagggtccccgctcagctcctgggctcctgctgctctggttcccaggttccagatgcgacatccagatgacccagtctccttcttccgtgtctgcatctggtaggagacagagtccaccatctacgttggtcgggcgtagtcgagggtatagactaagtggttacgccgtggtatcagacaacgaaaccgaacggaaaaaccgtcccctaaaaccgtccgtagtaacttacctagtcgtacgtcgtacaacgttaccccgtaacggttacggaaaccgtaaaagggttcgggtaacccccggttacccccgggtaacgtaaacggggttacccgaaggtacccggggaccgtaagggttacgggggtaccggtacgggggtaaccgggtttaactttaccggaaacttacccgttacccaacctactacccgaacccgtacgtaccccgtaggccctaacggacccgttaaggtaaaacgtttacgttttaacggtaaccctttaaaacgttttagttttaacgtttacggaacccgttaaaacgtaaacgggttaccttttaaaacccgtttccgttttttacccgtacccgttaacccggttacccggggttcgggaaacccgggggtaaaccggggttaaccccgtaaagggttcggggtaaaaccggtaacgttaaaacccggttaggttcggttaacgggnttaaccgacggtaccccttagttccccgttaagtttaacccc

SEQ ID NO: 305479 - DNA, 727 bp, Homo sapiens
  misc_feature: GZ8MTXP01E1GL2.21.47.E03.1.454.CMB.2.raw
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
tcagtcgtcgctcgcacgaccggtgctcgatttagactcgcgcacagagagaaggggggcaggagtcagacccagtcaggacacagcatggacatgagggtccccgctcagctcctggggctcctgctgctctggttcccaggttccagatgcgacatccagatgacccagtcttccttcttccgtgtctgcatctgtagagacagacgtcaccatcacgttggtcgggcgagtcgagggtattagcaactggtanccnggtatcagcaagaaaccaggaaacnccccctaaatcctagactctatgactcgctaactccgacggtttacgaacctaaagggtcggtacccgttacccccggtataaacgggtttccagggtaacccgggtacgaaggggtttcgggggtaccgtacgggggtaaccggtttactttaccgaaacttcccttaccaacccgtacctaacccgaaaccgtccggtccctaccggaccgtacgtccccgttaagggtaaacgtttaacttttcggaaaccttaacctttagtttacgttacgtacccgaaagtaccggttaacgtttaaacccttcgttttcccgtaccctttcgacccggggtttcggggaaccgggtaacgggttaaacccaaacgggttacggaacggtaacccgaaacggttaccgttgggtcgacgttcgaccctaccttactcttcgttcccg

SEQ ID NO: 305480 - DNA, 234 bp, Homo sapiens
  misc_feature: GZ8MTXP01DBMIU.21.47.E03.1.454.CMB.2.raw
  modified_base (234)..(234): a, c, t, g, unknown or other
  misc_feature (234)..(234): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagagacagagtcaccatcattgcggcgagtcaggtatn

SEQ ID NO: 305481 - DNA, 618 bp, Homo sapiens
  misc_feature: GZ8MTXP01D07SE.21.47.E03.1.454.CMB.2.raw
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgaccccagtccttccttcttccgtgtctgcatctgtaggagacagacgtcaaccatctacttggcgggcgagtcgaagggttatagacaaacgttggtagctaggtatcaggacaacgaaaactaacggaaaactccccctaaaaactcctagacttacatagctgactatacctagttgactaaaaggtggtaaccgtccccgtanaaacggttnagtacggcaagggtgggtcgtagggggactagtttacaattcacacgactcgaaccncgcagactacgctagtaattagttacgacttaacgttattagtctaacgaacgtagtaacttaacgttacgtttcctaccgtacgtacgggttcgggaacgggtaaacggaccgtaaggttacggaacgtaaacttaaacggttcgttcgtaacgcgtaacgcctaacttcttcgttcgtcg

SEQ ID NO: 305482 - DNA, 594 bp, Homo sapiens
  misc_feature: GZ8MTXP02GWR04.21.47.E03.1.454.CMB.2.raw
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcaggggtattagcaactggttancctggtatcagcaagaaccaggaaacncccctaaactctagatctatgctgcatccagttgacaaagtgaccgtcccgtanaaggtcagcgcnggtgggtctggggacgtatttcaatcctacaccatcacagcctagcagcctagaagtatttagacttaaactttatttacgttagtacaaacgtacggtacttaaacgttacgttttacctcttacgtaacgggttccggacgggtaacgggtaacccgtaaacgggttacgggaaacgggttaaccgaaaaacggtaccgttaggtaacggtcgtacggaccaacccgtacgttaccttacgtttccc

SEQ ID NO: 305483 - DNA, 502 bp, Homo sapiens
  misc_feature: GZ8MTXP02FI43W.21.47.E03.1.454.CMB.2.raw
  modified_base (329)..(329): a, c, t, g, unknown or other
  misc_feature (329)..(329): n is a, c, g, or t
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgcggcgagtcagggtattagcaactggtagcctggtatcagcagaaaccaggaaaagcccctaaactcctgatctatgctgcatccacgttgcaaagtggacgtcccgtnaaggttcagcggcaggtgggtctggggacgatttcaatctcacatcacagcctgcagcctgaaagtatttagactaacttattattgtacaacaggtactaactagttttccnctctacgttcggacggacggacaacgtggacgtacaaacgactgngctgacacatctgtc

SEQ ID NO: 305484 - DNA, 528 bp, Homo sapiens
  misc_feature: GZ8MTXP02FOUWE.21.47.E03.1.454.CMB.2.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (398)..(398): a, c, t, g, unknown or other
  misc_feature (398)..(398): n is a, c, g, or t
tcagtcgtcgctcgcacgaccggtgctcgatttagactcgcgcacagagagaaggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcggcagtcagggtattagcaactggttagcctggtatcagcaagaaaccaggaaaacgcccctaaactcctgatctatgctgcatccacgttgcaaagtgacgtcccgtnaaggttcagcgcnggtgggctggggacgtatttcaatctcacatcaccagcctgcagcctagaaagtnttttagactaaactttattattagtacaaataggtactaacttacgttttcctctacgtacgttcggacggtaggacccgtaacggtggaacgtaccgaaaacgactagtggctagaccaccatcttctc

SEQ ID NO: 305485 - DNA, 497 bp, Homo sapiens
  misc_feature: GZ8MTXP02GVU1M.21.47.E03.1.454.CMB.2.raw
  modified_base (332)..(332): a, c, t, g, unknown or other
  misc_feature (332)..(332): n is a, c, g, or t
tcagtcgtcgctcgcacgaccggtgctcgatttagactcgcgcacagagagaaggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcaggggtattagcaactggttagcctggtatcagcagaaaccaggaaaagcccctaaactcctgatctatgctgcatccacgttgcaaagtggacgtcccgtnaaggttcagcggcagtgggtctggggacgatttcaatctcacatcacagcctgcagcctgaagatttgactaacttattattgtacaacagctaaactgtttacctctactacgttcggcggaggaccaacgtggaacgtcaaacgactgtgctgcacatctgtc

SEQ ID NO: 305486 - DNA, 603 bp, Homo sapiens
  misc_feature: GZ8MTXP02IFW4V.21.47.E03.1.454.CMB.2.raw
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcaggggtattagcaactggttagcctggtatcagcagaaaccaggaaaacgccccctaaatcctgatctatgctgcatccagttgcaaagtggacgtcccgtanaaggttcaggcggcnggtcgggtctgggggacgtatttcaattctacacatcacagccctagcagcctagacgtattttgactaaactttatttattgtacaaacgtaggacttaactagtttttccctcttaccgtaacggtttcgggacgggtaacggggtaacccctaaacgggttaggggtaaacgggttaccgaaaaacggtaccgttagggtaacggggtaccttacggtaccgaaccccgtatttcccgttaggtttccccg

SEQ ID NO: 305487 - DNA, 519 bp, Homo sapiens
  misc_feature: GZ8MTXP02JU6P0.21.47.E03.1.454.CMB.2.raw
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcgcgcacagagagaaggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggttagcctggtatcagcagaaaccaggaaaagcccctaaatcctgatctatgctgcatccacgttgcaaagtggacgtcccgtnaaggttcagcggcnggtgggtctggggacgatttcgaaatctcacatcacagccctgcagcctgaagtattttgctaaactttattaattgtcaaacnggtacttaaactagttttcctcttcacgtttcggcggagggtaccaaacggtggaacggtacaaaacgtactgtggctagcaccatctgttc

SEQ ID NO: 305488 - DNA, 549 bp, Homo sapiens
  misc_feature: GZ8MTXP02J2CCW.21.47.E03.1.454.CMB.2.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggttagcctggtatcagcagaaaccaggaaaacgcccctaaatcctgatctatgctgcatccagttgacaaagtgacgtcccgtanaaggttcagcggcnggtgggtctgggacgtatttcaatctcaccatcacagccctgccagcctagaagtattttgactaacttattattagtactaaacgaggaccttaaactacgtttttcctacttcgtaacggtttcgggacggaacggggaccaaacggttggaacgggtacaaaacggtaactggtggactcggacctaccatccgtgttacc

SEQ ID NO: 305489 - DNA, 578 bp, Homo sapiens
  misc_feature: GZ8MTXP02JBQ52.21.47.E03.1.454.CMB.2.raw
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttacgtgtctgcatctgtaggagacagagtcaccatcacttgtcgggcagtcagggtatagcaacgtggttagcctggtatcagcaagaaaccaggaaaacncccctaaatcctgatctatgctgcatccagttgacaaagtggacgtcccgtanaaggttcagcgcngggtgggtctggggacgtatttcaatctacacatcacagcctgcagctagaagtatttagacttaactttatttattacgtacaaacgtacggtacttaaacgttacgtttttaccctcgttaccgtacgggtttcgggaccgggtaacggggaacccgtaaacgggtgggaaacggtaaccaaaacggtaaccgtggtaacggactacggaccacctacgtccgttgttcc

SEQ ID NO: 305490 - DNA, 579 bp, Homo sapiens
  misc_feature: GZ8MTXP02JV9WS.21.47.E03.1.454.CMB.2.raw
  modified_base (338)..(338): a, c, t, g, unknown or other
  misc_feature (338)..(338): n is a, c, g, or t
  modified_base (351)..(352): a, c, t, g, unknown or other
  misc_feature (351)..(352): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcggcgagtcaggggtattagcaactggttagcctggtatcagcagaaaccaggaaaacgcccctaaactcctagactctatgctgcatccacgttgacaaagtggaccgtcccgtanaaggttcagcggnnggtgggtctggggacgtatttcgaatctacaccatccacagccctgcacgcctagaacgtatttagacttaaacttatttattagtactaaacgagtacttaacttacgttttcctcgtacgtacggttccggacgggtaacgggaaccgtaacgggtaggtaacgggttaaccaaaaccggacgttagggcggtacgtacggacctaccacttaccgtcgtttacc

SEQ ID NO: 305491 - DNA, 542 bp, Homo sapiens
  misc_feature: GZ8MTXP02JUZRN.21.47.E03.1.454.CMB.2.raw
  modified_base (251)..(251): a, c, t, g, unknown or other
  misc_feature (251)..(251): n is a, c, g, or t
  modified_base (334)..(334): a, c, t, g, unknown or other
  misc_feature (334)..(334): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggttancctggtatcagcaagaaaccaggaaaacgcccctaaatcctgatctatgctgcatccacgttgacaaaggtgacgtcccgtanaaggttcagcggcaggtgggtctggggacgtatttacaattcctacaccatccacagcctgcagcctagaacgtatttgacttaaactttattattgtacaaacaggtaccttaacttcgttttacctcttcgtacggttcggacggacggaccaaggtcggaacgtacgaaacgtaacgtgtaaggctagaccaacctctctacgtc

SEQ ID NO: 305492 - DNA, 560 bp, Homo sapiens
  misc_feature: GZ8MTXP02IC9PB.21.47.E03.1.454.CMB.2.raw
  modified_base (298)..(298): a, c, t, g, unknown or other
  misc_feature (298)..(298): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggtagcctggtatcagcagaaaccaggaaaacgcccctaaactctgatctangctgcatccatgacaaagtggacgtcccgtacaagttcagcggctaggtgggtctggggacgtatttcaatctccacatcaccagcctgcagcctagagtatttgactaaacttattattgtcaaataggtacttaaactgtttttcctactcctaacgggtttcggaccggggtaacgggacccgaaacggtttagggaacgggttaccaaaaaccggtacgttggcggggtaccttggacaacccctattctacgtttcc

SEQ ID NO: 305493 - DNA, 570 bp, Homo sapiens
  misc_feature: GZ8MTXP02FNSRY.21.47.E03.1.454.CMB.2.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (411)..(411): a, c, t, g, unknown or other
  misc_feature (411)..(411): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggtagcctggtatcagcaagaaaccaggaaaacgcccctaaactcctagatctatgctgcatccagttgacaaaggtggacgtcccgtanaaggttcaggcggcnggtgggtcgtggggacgtatttcaatcctacaccatcaccagcctgccagcctagaacgtnttttacgacttaaactttattatttcgtacaaacgtaggtaccttaaacttacgtttttcccacttacgtacggttccggacgggtaacgggacctaaacggtgggaaacgtacgaaaaccggtactaggtcggtctacgacctaccattccgtgttcc

SEQ ID NO: 305494 - DNA, 574 bp, Homo sapiens
  misc_feature: GZ8MTXP02GZV35.21.47.E03.1.454.CMB.2.raw
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtatagcaactggtagcctggtatcagcaagaaaccaaggaaaacgcccctaaaactcctagatctatgctgcatccagttnacaaagtggacgtcccgtanaaggttcagcggacnggtgggtctggggacgtatttcaaatcctacaccatccaaccagccctgccagcctagaacgtattttgacctaaatttacttattgtacaaacgtacggtactaaacttacgttttccctactacgtacggttcggacgggaacgggaacccgtaaacggtgggaaacggtaccaaaacgtacgtaggtaacggtctacggaccaccgtattcgttacgttcc

SEQ ID NO: 305495 - DNA, 532 bp, Homo sapiens
  misc_feature: GZ8MTXP02ITC2J.21.47.E03.1.454.CMB.2.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (456)..(456): a, c, t, g, unknown or other
  misc_feature (456)..(456): n is a, c, g, or t
  modified_base (527)..(527): a, c, t, g, unknown or other
  misc_feature (527)..(527): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttgtcggcgagtcaggggtattagcaactggttagcctggtatcagcaagaaaccaggaaaacgcccctaaactcctgatctatgctgcatccacgttncaaagtggactcccgtnaaggttcagcggcaggtgggtctggggacgtatttcaatctcacatcacagccctgccagcctagaaagtattttgactaaactttatttattcgtacaaacaggtactaaactagttttccncttacacggtttcggacgggaggaccaaacggtggaacggtacaaaacgtactgtaaggctgacacattcngttcc

SEQ ID NO: 305496 - DNA, 536 bp, Homo sapiens
  misc_feature: GZ8MTXP02GY7RJ.21.47.E03.1.454.CMB.2.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
  modified_base (334)..(334): a, c, t, g, unknown or other
  misc_feature (334)..(334): n is a, c, g, or t
  modified_base (415)..(415): a, c, t, g, unknown or other
  misc_feature (415)..(415): n is a, c, g, or t
  modified_base (524)..(524): a, c, t, g, unknown or other
  misc_feature (524)..(524): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgcttctctggttcccaggttccagatgcgacatccagatgacccagtctccttcttccgtgtctgcatctgtagganacagagtcaccatcacttgtcgggcagtcagggtattagcaactggttancctggtatcagcaagaaaccaggaaaacnccccctaaatcctagatctatgctgcatccagttgacaaagtgactcccccgtnaagttcagcgcaggtgggtctgggacgtatttcaatctacacatccacagcctgcagcctagaagtatttgactaactttnttattgacaacgagaccttaactacgttttccacgtacgtacggttcggacggtaacggaccctaggtggaacggtacaaaacggtactgtggaactcgaccaaccgtntcgtcgtactcg

SEQ ID NO: 305497 - DNA, 536 bp, Homo sapiens
  misc_feature: GZ8MTXP02H6DX1.21.47.E03.1.454.CMB.2.raw
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaacgtggtancctggtatcagcaagaaaccaggaaaacncccctaaactcctagatctatgctgcatccagttgacaaagtgaccgtcccgtanaaggtcaggcggcaggtggggtctggggacgtatttcgaaattcctcaccatccacacgcctgcagcctagagtatttgactaaacttatttatgtacaacaggtactaactacgtttccacttctacggttcggcggacgggtaccaacggtggaacgacgaaacgtacgttggcgactcgaccactacgtcttcgttc

SEQ ID NO: 305498 - DNA, 593 bp, Homo sapiens
  misc_feature: GZ8MTXP02IVYRM.21.47.E03.1.454.CMB.2.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttacgtgtctgcatctgtaggagacagagtcaccatcacttgtcgggcgagtcagggtattagcaacgtggtagcctggtatcagcaagaaaccaggaaaacgcccctaaactcctagatctatgctgcatccagttgacaaagtggactcccgntaaggtcagcgcnggtggtcgtggggacgtattcgaatctacactatcaccgnccctgcagcctgaatntttgacttaacttattatcgtacaaacgnggtactaaacgttacgttttcctacttcgtacggtttccgggacggggtaaacgggtaacccctaaagggttacggggaaccggttaaccgaaaaaccggtacgttcggtaacgggccttaacgggacctaacccggttatttcccgttaacggttttaccc

SEQ ID NO: 305499 - DNA, 568 bp, Homo sapiens
  misc_feature: GZ8MTXP02HS4L7.21.47.E03.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcaggggtattagcaactggtancctggancagcagaaaccaggaaaacncccctaaatcctgatctatgctgcactccacgttagacaaaggtggaccgtacccgtactaaggttcaggcggcgaggttggggtcgtggggacgtatttacaaattccacacactacaccacgccctgcagcctagtaagtatttagacctaaatttatttatgtacaacaggtactaaacttacgtttacctctacgtacggttcggacgggacgggaaccctaaacggttagggaacgttaaccgaaaacgaacgttggtggctacgacaccctatacgttctccc

SEQ ID NO: 305500 - DNA, 640 bp, Homo sapiens
  misc_feature: GZ8MTXP02JR90J.21.47.E03.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (347)..(348): a, c, t, g, unknown or other
  misc_feature (347)..(348): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtaggagacagagtcaccatcacttggtcgggcgagtcgagggtattagcaactggttancctggtancagcaagaaaccaggaaacncccctaaactctagatctangctgcatccagttnacaaagtgaccgtcccganaaggtcaggcggnnggtgggtctaggggacgtatttacgaactccgtacaccataccaccgtacgccctgcacgcctaaggaaacgttnttttacgaacctttaaatttatttacgttacgtaactaaacgtacggttaaccttaaaccggtttacgttttcccctacgtacccgttaaccggggttccggggaaccggggtaaacgggacccgtaaacggggtacgggtaacggtaaccctaaaacgggtaccgtggttaaccgggccgttacggaccctaacctcggttaccttacggtttccc

SEQ ID NO: 305501 - DNA, 530 bp, Homo sapiens
  misc_feature: GZ8MTXP02JZ0TZ.21.47.E03.1.454.CMB.2.raw
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaacgcccctaaactcctgatctatgctgcatccagttgacaaagtggacgtcccgtnaaggttcagcggcnggtgggtctggggacgtatttcaatctcaccatcaccagccctgccagcctagaagtattttgactaacttattattgtacaactaggacttaaactacgttttccncttacgacgttcggcggaagggaccaacggtggaacggtacaaaacgtacgtggtcgctacgcacctctctgttcc

SEQ ID NO: 305502 - DNA, 628 bp, Homo sapiens
  misc_feature: GZ8MTXP02G26SP.21.47.E03.1.454.CMB.2.raw
  modified_base (511)..(511): a, c, t, g, unknown or other
  misc_feature (511)..(511): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcaccatcacgttgtcgggcgagtcgaggggtattagacaactggttagcctggtatcagcaagaaaccaggaaaacgcccctaaactcctagatctatgctgctactccacgttagaccgtaaaggtcggaccgtccccgtagtaaggttcaggcggacgtagggtgggtacgtagggggtacgtatttacaattcctacaccgtactaccaccacgcccgtgaccagtcctagaacgttattttacgacttaaactttatttatcgtacaaacgtacggtacttaacgttacgttttcccncgttaccgtacggttccggggacgggtacgggaaccgtaacgggttacgggaacggttaccgaaaacggtaacgtggttaacggacttacggacctacctacgttccttacgttccc

SEQ ID NO: 305503 - DNA, 579 bp, Homo sapiens
  misc_feature: GZ8MTXP02GZDBL.21.47.E03.1.454.CMB.2.raw
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (343)..(344): a, c, t, g, unknown or other
  misc_feature (343)..(344): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtaggagacagagtcaccatcacttgcggcgagtcagggtattagctaactggtancctggtatcagcaagaaaccaggaaaacncccctaaatcctagatctatgctgcatccagttgacaaagtgaccgtcccgtanaaggtcagcgnnggtggcngggacgtnttcaatcacacatcacagcctgcacgcctagaaacgtntttagactaaactttattagttactacgaaacgtagtacttaaacgttagtttaccctactacgtaaccgggttcggaccgggtaacgggaacccgtaaacggtcgggtaaacggtaccgaaaaccggtaacgtcggttaacggacgttacggaccaaccgtaacttccgttcgtttacccg

SEQ ID NO: 305504 - DNA, 499 bp, Homo sapiens
  misc_feature: GZ8MTXP02GKYAZ.21.47.E03.1.454.CMB.2.raw
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (440)..(440): a, c, t, g, unknown or other
  misc_feature (440)..(440): n is a, c, g, or t
  modified_base (484)..(484): a, c, t, g, unknown or other
  misc_feature (484)..(484): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggtagcctggtatcagcagaaaccaggaaaacgcccctaaatcctgatctatgctgcatccacgttgacaaagtggacgtcccgtnaaggttcagcggcngtgggtctgggacgatttcaatcncaccatcacagcctgcagcctgaagtatttgactaacttattattgtacaaacagactaacagttttccnctcacgttcggcggaggaccaacgtggacgtacaaacgtactgnggctgcacatctgtc

SEQ ID NO: 305505 - DNA, 569 bp, Homo sapiens
  misc_feature: GZ8MTXP02IT32A.21.47.E03.1.454.CMB.2.raw
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttancctggtatcagcaagaaaccaggaaaacgcccctaaactcctagatctatgctgcatccacgttgacaaagtggacgtcccgtanaaggttcagcggcnggtgggtctggggacgtatttcaatctcacatcacagccctgcagcctagagtntttgactaaactttatttattgtacaaacgtacggacttaaactacgttttaccctcttaccgtacggtttccgggacgggaacgggtaccgtaacggtagggaacggttaccgaaaaacggtacgtaggtaacggtctacggaccaacctatccttacgttcc

SEQ ID NO: 305506 - DNA, 532 bp, Homo sapiens
  misc_feature: GZ8MTXP02HZVXV.21.47.E03.1.454.CMB.2.raw
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
  modified_base (280)..(280): a, c, t, g, unknown or other
  misc_feature (280)..(280): n is a, c, g, or t
  modified_base (334)..(334): a, c, t, g, unknown or other
  misc_feature (334)..(334): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagtcgtcgctcgcacgaccggtgctcgatttagactcgcgcacagagagaagggggcaggagtcagacccagtaaggacacagcatggacatgagggtccccgctcagctcctggggctcctgctgctctggttcccaggttccagatgcgacatccagatgacccagtctccttcttccgtgtctgcatctgtagganacagagtcaccatcacttgtcgggcagtcagggtatagcaactggttancctggtatcagcaagaaaccaaggaaaacnccccctaaaatcctagatctatgctgcatccagtgacaaagtgacgtccccgtnaaaggttcagcgcaggtgggtctgggacgtattacaatctcaccatcaccagcctgcagcctagaatntttgactaatttatattnacaacagtactaaactgtttccnctcgtacggtcggacgggtacggaaccgtaaacggtggtaacggtacaaaacgaacgtgtaggccgtcgacacctagtctacgtcttac

SEQ ID NO: 305507 - DNA, 528 bp, Homo sapiens
  misc_feature: GZ8MTXP02J02HO.21.47.E03.1.454.CMB.2.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcggcgagtcagggtatagcaactggttancctggtatcagcaagaaaccaggaaaacncccctaaactcctagatctatgctgcatccacgttgacaaagtggacgtccccgtanaaggttcaggcggnaggtgggtctggggacgtntttcaatctcacatcacagccngcagctagatntttgataacttattattgactaanagtactaactgtttcctctactacgttcggacggacgggaccaacggtggaacggtacaaaacggtacctggtcggtctacgaccaacgtcttcgtacttcc

SEQ ID NO: 305508 - DNA, 543 bp, Homo sapiens
  misc_feature: GZ8MTXP02JO101.21.47.E03.1.454.CMB.2.raw
  modified_base (524)..(524): a, c, t, g, unknown or other
  misc_feature (524)..(524): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggttagcctggtatcagcaagaaaccaggaaaacgcccctaaactcctagatctatgctgcatccacgttgcaaagtggaccgtccgtacaaggttcagcggcagggtcggggtctgggggacgtatttcgaaatctacaccatcaccagcctagccacgcctagaacgtattttagactaaactttattattacgtacaaacgacggtacttaacgtagtttcctacgtctacggttcggacggacggaccgaacggtggaacgtacgaaacgactgngctcgacactactctcgtc

SEQ ID NO: 305509 - DNA, 686 bp, Homo sapiens
  misc_feature: GZ8MTXP02FXD8Q.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcagtcgaggggttattagctaacgtggttacgcctggtatccgagacaacggaaaaccaaggaaaaccgccccctaaaactccgtagatctagtgctgacctatccgtaacggttgacgtaaaggtcggtacccgtccccgtagtaaacgggttcagggccggcgtaggggttcggggtacgtgggggaaccggtatttacgaaactcctaccaccacgtccaaccgtacgccgtcgctacgtaccgtagaaacgttattttacgaacttaaactttattacgtttacgttaaccaaacgtacggtacttaaacgttacgttttaccctcgttaccgtacggttaccggggacgggtaacgggtacccgtaaacgggtacgggtaacggttaaccgaaaaccggtacggttcggtaacggtaccgtacggaccctaccggtacttccgttacgtttaccg

SEQ ID NO: 305510 - DNA, 593 bp, Homo sapiens
  misc_feature: GZ8MTXP02JBJ6Z.21.47.E03.1.454.CMB.2.raw
  modified_base (257)..(257): a, c, t, g, unknown or other
  misc_feature (257)..(257): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgaggggtattaggcaacgtggttancctggtatcagcaagaaaccaggaaaacgcccctaaatcctagatatatgctgacatccagttgacaaaggtgacgtcccgtanaagtcagcggnaggtcgggtctggggacgtatttacgaatctacacatcacagcctagcagctagaagtatttgacttaaattattatacgtacaaacgtaggtaccttaaacttcgttttcccacttaccgtaacggttccgggacgggtacggggtaaacccgtaaacggggtaggtaaacggggttaaccaaaaaccggtcgttaggtaacgggaccttacggaccactacggtttccctagtttaccc

SEQ ID NO: 305511 - DNA, 609 bp, Homo sapiens
  misc_feature: GZ8MTXP02I9ZU4.21.47.E03.1.454.CMB.2.raw
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgaggggtattagcaacgtggtagcctggtatcagcaagaaaccaggaaaacncccctaaatcctagatctatgctgcatccagttnacaaagtgaccgtccgtanaaggttcaggcggactggggtgggtacgtaggggacgtatttacgaaatccgtacaccataccaccagcctgcagcctagaatntttagacttaaacttattattcgtactaaacgtacggtaccttaaacgttacgttttccctacgtaccgtacgggttccgggaccgggtaacgggaaacccgtaacgggtacggtaaacgggtaaccgtaaaaccggtacgtaggtaaccggacgtacgacctaaccctagttaccgttcgtttaccc

SEQ ID NO: 305512 - DNA, 698 bp, Homo sapiens
  misc_feature: GZ8MTXP02IXBBL.21.47.E03.1.454.CMB.2.raw
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaacgtggttagcctggtatcagacaagaaaccaggaaaacncccctaaancctgatctatgctgcatccacgttgacaaaggtcgaccgtcccgtagtaaggttcaggccggcgtaggggttcgggtcgtagggggtaccgttactttacaaacttcctaccacctactaccaaaccgtagccctaggccaaggtcccttaagggtaaaacgtttctttttaacggaacccctttaaacttttaatttaacgtttacgtaaccgtaaaacgtaaccggttacctttaaaaccgttcggtttttaccccacgtttaccgtacggggtttaccggggaacgggtaacggggtaaacccgtaaaccgggtttggggaaacggttaaacccgaaaaacggttaccgttagggtcgggtacctacggtaccctaaaccgtactttccggttcgtttaaccc

SEQ ID NO: 305513 - DNA, 572 bp, Homo sapiens
  misc_feature: GZ8MTXP02I7F1X.21.47.E03.1.454.CMB.2.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcaggggtattagcaactggttagcctggtatcagcaagaaaccaggaaaacgcccctaaatcctgatctatgctgcatccacgttnacaaagtgacgtccgtnaaggtcagcggcnggtggtcgtgggacgtnttcatcacacatcacanccctgcagcctagacgtattttacgacttaaactttatttattacgtactaaacgtacggtaccttaaacgtttacttttcctaccttacgtaacggttcgggacgggacgggtaacctaaacggggtaggtaacggtacaaaacggtaacttgggtcggtactacgaccctaactacgttcctcgtttacc

SEQ ID NO: 305514 - DNA, 633 bp, Homo sapiens
  misc_feature: GZ8MTXP02JXW96.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttttccgtcgtctcgcactctcgtagggtaaggaacgaacgaaggtacctaacccaactactaccttacgttcggggccggacggtacgtagggtaaggttaagtacgaactaggttaggtaccgtcggttagttacacgacgaacgaaaccgaaacggaaaaggaaacccctaaccctaacctcgtatactactagtctcgtcactcctaccgttgtacaaagtaggtagtacccccggtaccgtaagtacgtacgacggcgacgtggggtcgtcgggtacgggagttatactactcaaccactcacccaagcctgcacgctcgtaagactttgtacactttaattattagctaacaggtataaccttacgtttccttctcacggttacgcgggaacggacgtaacgcggtaggtaccaacgaactcgtggccgatcgaccactcttcggtactttc

SEQ ID NO: 305515 - DNA, 598 bp, Homo sapiens
  misc_feature: GZ8MTXP02HUTLP.21.47.E03.1.454.CMB.2.raw
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (343)..(344): a, c, t, g, unknown or other
  misc_feature (343)..(344): n is a, c, g, or t
  modified_base (370)..(370): a, c, t, g, unknown or other
  misc_feature (370)..(370): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgcgggcagtcagggtattagcaactggtancctggtatcagcaagaaaccaggaaaacncccctaaactcctgatctatgctgcatccagttgacaaagtgacgtcccgtanaaggtcagcggnnggtgggtctgggacgtattcaattcncacatcacagccctgccagcctagaagtattttagacttaaactttatttattacgttacaaaacacggtacttaaaacgttacgtttttccctacgttacgtaccggtttaccggggacggtaacggggtaaccgtaaacggttacgggtaacggttaacgaaaaaccggtaccgtaggtaacgggtactacggtacccaaccgtaacttacggtttacgtttcccg

SEQ ID NO: 305516 - DNA, 616 bp, Homo sapiens
  misc_feature: GZ8MTXP02HYN56.21.47.E03.1.454.CMB.2.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
  modified_base (372)..(373): a, c, t, g, unknown or other
  misc_feature (372)..(373): n is a, c, g, or t
  modified_base (381)..(381): a, c, t, g, unknown or other
  misc_feature (381)..(381): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttggtcgggcgagtcgaggggttattagctaaacgttggttagcccttggtatcaagacaagaaaacccgaaggaaaaccgccccctaaaatcctagactctatgctgactatccagttgacaaaggtcggaccgtcccgtanaaggtcagcggnnggtgggtntggacgtattcaatctacacatccacagccctgaccacgacctaggtaagttatttacgaccttaaatttatttagtacgtaactaaacgtaggtaaccttaaacttcgttttccctacttaccggtaacgggttaccggggtacgggaaaccgggttaacccgaaaggttaggggaacggttaaccaaaacggtacgtgggtaacgctacgacctaacgtactcgtttacgtcc

SEQ ID NO: 305517 - DNA, 520 bp, Homo sapiens
  misc_feature: GZ8MTXP02I5GYI.21.47.E03.1.454.CMB.2.raw
  modified_base (252)..(252): a, c, t, g, unknown or other
  misc_feature (252)..(252): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcaggggtattagcaactggttancctggtatcagcagaaaccaggaaaagcccctaaactcctgatctatgctgcatccacgttgcaaagtggacgtcccgtacaaggttcagcggcaggtgggtctgggacgatttcaatctacacatcacagctagcagcctagagatttagctaactttattatgtacaaacacggacttaactagtttcctcttactacgtttcggacggtagggaccaacggtaggacggtacaaaacgaatcgtaaggctgacaccagtctgttc

SEQ ID NO: 305518 - DNA, 602 bp, Homo sapiens
  misc_feature: GZ8MTXP02HKIR2.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgcggcgagtcagggtattagcaacgtggtagcctggtatcagcaagaaaaccaaggaaaaacgcccctaaactcctagactctatgctgcatccacgttgacaaaggtggaccgtcccgtagaaggttcaaggcggacagggttggggtactgggggaacgtatttacgaaattcctaccaccataccaacccgaggccctggaccagtaccctagagttattttgactaaactttattattagacaaactaggtacctaaactcgttttaccacttacgtaaccggttcgggaacgggtaggggaccctaaagggttcggaaacggttaccgaaaaacggtaacgtggtaacggctacggacctactacgttcctagttccc

SEQ ID NO: 305519 - DNA, 564 bp, Homo sapiens
  misc_feature: GZ8MTXP02JBNLL.21.47.E03.1.454.CMB.2.raw
  modified_base (247)..(247): a, c, t, g, unknown or other
  misc_feature (247)..(247): n is a, c, g, or t
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (339)..(340): a, c, t, g, unknown or other
  misc_feature (339)..(340): n is a, c, g, or t
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcattgcggcagtcagggtattagcaactggtancctggtatcagcaagaaaccaggaaaacgcccctaaatcctgatctatgctgcatccagttncaaagtgacgtcccgtanaaggttcagcgnnggtggtcnggggacgtatttcaatctacaccatcacagcctgccagtcctagagtntttacgctaaacgtttattattcgtacaaactaggtacttaactcgttttacctcttaccgtacggtttcggacgggtacgggacctaaacgggtcggtaacggttacgaaaaaccggtcgtaggtaacggcgttacggaccctaaccgtacgttcctacggtttccc

SEQ ID NO: 305520 - DNA, 576 bp, Homo sapiens
  misc_feature: GZ8MTXP02HO22U.21.47.E03.1.454.CMB.2.raw
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (348)..(349): a, c, t, g, unknown or other
  misc_feature (348)..(349): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcaccatcacttggtcgggcgagtcgaggggtattagcaactggtagcctggtatcagcaagaaaaccaggaaaacgcccctaaatccngatctatgctgcatccacgtgacaaaggtgacctccgtanaaggtcagcgnnggtgggtctggggacgtatttacgaaattccctacaaccatcaacctaggccctgacacgcctagaatntttagcttaaatttattatgtacaaacgtaggtactaaacgtcgtttccacgttaccgtaacgggttcgggacggtaacgggtacccaaagggtcgggaaacgtaacaaaaccggtagttacgggcgtacgtacgacctaactcgttacttacgttcc

SEQ ID NO: 305521 - DNA, 643 bp, Homo sapiens
  misc_feature: GZ8MTXP02FSKUI.21.47.E03.1.454.CMB.2.raw
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
  modified_base (479)..(479): a, c, t, g, unknown or other
  misc_feature (479)..(479): n is a, c, g, or t
  modified_base (538)..(538): a, c, t, g, unknown or other
  misc_feature (538)..(538): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatcgacccagtctccttcttccgtgtctgcatctgtaggagacagacgtcaccatctacgttggtcgggcgagtcgagggtattacgctaacgtggttagcctaggtactcgagacaagaaaaccaaggaaaaccncccctaaactcctagactctatcgctgaccactccgacgttgacgtaaaggtcggacccgtccccgtagtaacggttcaacggccggngtacgggtcggggtaccgtagggggtaccttatttacgaaacttcctaccacctactaccaacccgtagccctagccacgtccgtagtaagttntttaacgacttaatttacttagttacgtaacgaagtacgtacttaacttcgttttaccncgttacgtacgggttcggaacgggacggtaccgaaaggtagggtaacgtaacgtaaaccgtaggtacggtaaggtctacgaccctactacttccgttacgtttcc

SEQ ID NO: 305522 - DNA, 526 bp, Homo sapiens
  misc_feature: GZ8MTXP02HP11R.21.47.E03.1.454.CMB.2.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (384)..(384): a, c, t, g, unknown or other
  misc_feature (384)..(384): n is a, c, g, or t
  modified_base (441)..(441): a, c, t, g, unknown or other
  misc_feature (441)..(441): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggtagcctggtatcagcaagaaaccaggaaaacgcccctaaactcctagatctaatgctgcatccagttgacaaagtggactcccganaggtcagcgcnggtgggtctgggacgtatttcgaaatctacacatcacancctgcagcctagatatttgactaattattatgtacaacagtactaactagttttccncttacgacgttccggacgggacggtaccaaacgtgggacggtacaaaccggtaatgtggactcgactaaccagttacctgttacc

SEQ ID NO: 305523 - DNA, 574 bp, Homo sapiens
  misc_feature: GZ8MTXP02GSTMC.21.47.E03.1.454.CMB.2.raw
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaacgtggttagcctggtatcagcaagaaaccaggaaaacgcccctaaactcctagatctatgctgacatccacgttgacaaaggtggaccgtcccgtnaaggtcaggcggcngggtgggtcgtggggacgtattacaatctacacatcaccagcctagccacgcctagaagtatttgactaaactttattattagtacaacgagacttaactcgtttctcctctacgtacggttccggacgggaacgggtacccgtaagggtacgggtaacggttaaccgaaaacggtaccgtaaggtcggacttacggacctaccgtacgttccgtttacg

SEQ ID NO: 305524 - DNA, 665 bp, Homo sapiens
  misc_feature: GZ8MTXP02FR2ZV.21.47.E03.1.454.CMB.2.raw
  modified_base (283)..(283): a, c, t, g, unknown or other
  misc_feature (283)..(283): n is a, c, g, or t
  modified_base (466)..(466): a, c, t, g, unknown or other
  misc_feature (466)..(466): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcaccatcacttggtcgggcagtcaggggtattagctaagtggttagcctggtatcagcaagaaacaggaaaacncccctaaatcctagatctatgctgctatccgtacgtgacgtaaaggtcggaaccgttccccgtagtaaaggttcaaggccgggacgtaggggtcggggtacgtaggggggtaaccgtattttaccgaaacttcctaccaaccctatacccaaccagtccctagaccagtaccgtagaaagttnttttacgaacttaaactttattagttagtaacaaacgtacggtacttaaacttacgtttttacctccgttaccgttaccgggttaccgggacggggtaacgggtaacccgtaaacgggtacggggtaaacggttaaccgaaaaaccggtagttaggtaacggtacctacggacctaaccgtacttccgttacgttcccg

SEQ ID NO: 305525 - DNA, 670 bp, Homo sapiens
  misc_feature: GZ8MTXP02GMRZ6.21.47.E03.1.454.CMB.2.raw
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggngagtcgagggttattagctaagttggtacgcctggtatcgagacaaacgaaaccgaggaaaaccgcccctaaactccgtagactctancgctgcctatcctacgttgaccgaaaggtcgaccgtcccgtataaggttcaggccgtagngggttcgggtcgtaggggtacgtatttacgaaagtccttacgacctactaccaaccgacgtccctgaccacgtaccgtagtaaagttactttacgaacttaaacgtttatttacgttacggttaaccaaacgtacggttaaccttaaacgttaccgttttaccctcgttaccgtacggggttacccgggacgggtacgggtaaaccgtaacgggttacgggtaacggttaaccgaaaaccggtacgttagggtaacgtacgttacggacctaaccgtacttccgttacgtttcccg

SEQ ID NO: 305526 - DNA, 607 bp, Homo sapiens
  misc_feature: GZ8MTXP02IF0YZ.21.47.E03.1.454.CMB.2.raw
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcggcgagtcgagggtattagcaacgtggtagctggtatcagacaagaaaccaggaaaaccncccctaaatcctagatctangctgcatccacgttagactaaaggtggacccgtcccgtagtaaggttcaggcggctggggtcgggtcgtagggggacgttatttacaacttcctaccaccactccacacgccctgacacgtcctaggtaactacgtttagaccttaaacgtttatttacgttacgtacgaaaccgtaaggtaccttaaacgttcgttttacctccgttacgtacggttcgggaacgggtacggaccgtaacgggtacggaacggtacgaaaacgtacgttggcggtactacggctacctacgttctacgtttac

SEQ ID NO: 305527 - DNA, 525 bp, Homo sapiens
  misc_feature: GZ8MTXP02JRFMZ.21.47.E03.1.454.CMB.2.raw
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (423)..(423): a, c, t, g, unknown or other
  misc_feature (423)..(423): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtaggagacagagtcaccatcacttgtcgggcagtcaggggtattagcaactggttagcctggtatcagcagaaaccaggaaaacgcccctaaaactcctagatctatgctgcatccagttnacaaagtcggacgtcccgtanaaggttcagtcggcagtcggggtactggggacgtatttcaatctcaccatcacagcctgcagctagatatttgactaacttatattnacgaacacggacttaaacgtacgttttccncttcgtaacgttcggacggacggtaccaacggtggacgtacgaaacgtactgtaaggctgcaccgatctgtc

SEQ ID NO: 305528 - DNA, 524 bp, Homo sapiens
  misc_feature: GZ8MTXP02GDLRH.21.47.E03.1.454.CMB.2.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
  modified_base (441)..(441): a, c, t, g, unknown or other
  misc_feature (441)..(441): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagatcaccatcacttgcggcagtcagggtatagcaatggtanctgtancagcaagaaaccaggaaaacncccctaaatcctgatctatgctgcatccacgttgacaaaggtgaccgtccgtacaaggttcaggcgcngggtgggtctggggacgtatttcaatctacacatcacagcctgcagctagagtntttagacttaattattattgtacaacgagtactaaactgttttaccnctacgtacggttcgacggtaggaacccgaagtggaacggtacaaaacggtctaggtcggctacggaccacctatcgtacgttc

SEQ ID NO: 305529 - DNA, 581 bp, Homo sapiens
  misc_feature: GZ8MTXP02I2RKT.21.47.E03.1.454.CMB.2.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (382)..(382): a, c, t, g, unknown or other
  misc_feature (382)..(382): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttgtcggcgagtcagggtattagcaactggttagcctggtatcagcagaaaccaggaaaacgcccctaaancctagatctatgctgcatccagttnacaaagtgacgtcccgtnagttcagcgctggtcgggcgtgggacgtatttcaaatctacaccatccacngcctgcagcctagaatatttagactaaactttattacttagtactaaacgtggtacttaaacgttacgttttccctcttaccgtaacggttcgggaaccgggacggggtaaaccgtaacgggttacgggaacggttaaccgaaaacggtaccttacgggtaaggtctacggacctaacctaacgtccttacggtttccc

SEQ ID NO: 305530 - DNA, 686 bp, Homo sapiens
  misc_feature: GZ8MTXP02G7JU3.21.47.E03.1.454.CMB.2.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttggtcgggcagtcgagggttattagctaacgttggtagcctggtatcgagacaacgaaaccaggaaaaccncccctaaatcctagatctatgactgactactccacgttagactaaaggtcggaacccgttcccgtagtaaacggttcgacgggtcggtacgtaggggttcggggttacgtagggggtaacccgttagttttaccaaagttccctaccgaacctaactacccgaaccacgtcccgtgaccgacgtaccttaggtaacgtttacttttaacgactttaaaactttatttaagtacgttaacaaacgtacgtaccttaaacgttcgttttacctcgtacgtaccggtcggggtacgggtaacgggtaacccgtaggttacggaaacgggtaaccgtaaaacggtaccgttaggggaacggtacctacggtaccaaccggttactccggttacgtttaccc

SEQ ID NO: 305531 - DNA, 567 bp, Homo sapiens
  misc_feature: GZ8MTXP02F0DF1.21.47.E03.1.454.CMB.2.raw
  modified_base (279)..(279): a, c, t, g, unknown or other
  misc_feature (279)..(279): n is a, c, g, or t
  modified_base (331)..(331): a, c, t, g, unknown or other
  misc_feature (331)..(331): n is a, c, g, or t
  modified_base (401)..(401): a, c, t, g, unknown or other
  misc_feature (401)..(401): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtatagcaactggtagcctggtatcagcaagaaaccaggaaaacncccctaaatcctgatctatgctgcatccacgttgcaaagtggacgtcccgtnaaggttcagcggcagggtgggtctggggacgtatttcgaatctacacatcacagcctgcagcctagaatntttgactaaatttattattgtacaactagacttaacttacgttttccctctacgtacggtttcgggacgggtaacgggtaacctaacgggtagggaacggttaacgaaaaacggtaccgttaggtaacggggtctacggaccaaccgtacgttcgttaggtttccc

SEQ ID NO: 305532 - DNA, 561 bp, Homo sapiens
  misc_feature: GZ8MTXP02ITBO6.21.47.E03.1.454.CMB.2.raw
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtattagcaactggtagcctggtatcagcaagaaaccaggaaaacgcccctaaatcctagatctatgctgcatccacgttgacaaagtggacgtcccgtnaaggttcagcggcnggtgggtctgggacgtattcaaattctcacatcacagcctgcagcctagaagtatttagacttaaacttatttatgtacaaacaggacttaactacgttttcctatccgtacgttcgggacggaacgggtacctaacggttacgggaacggttaccgaaaaacgtaacgtggtaacgggacttacggacctaaccgtaacttcgttacgttacc

SEQ ID NO: 305533 - DNA, 584 bp, Homo sapiens
  misc_feature: GZ8MTXP02I7D6H.21.47.E03.1.454.CMB.2.raw
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (401)..(401): a, c, t, g, unknown or other
  misc_feature (401)..(401): n is a, c, g, or t
tcagtcgtcgctcgcacgaccggtgctcgatttagactcgcgcacagagagaagggggcaggagtcagacccagtcaggacacagcatggacatgagggtccccgctcagctcctgggctcctgctgctctggttcccaggttccagatgcgacatccagatgacccagtctccttctccgtgtctgcatctgtaggagacagagtcaccatcacttgtcggcagtcagggtatagcaactggtancctggtatcagcagaaaccagaaacgcccctaaatcctagatctatcgctgcatccagttgacaaagtgacctcccgtnaaggttcaggccgntggtgggtctgggaccgtatttcaaatcctacgaccatcaacagcctgcagccgtagacgtntttacggacttaaacgtttattacttacggtactaaacccgtaggtccttaaactacggttttaccctcgttaccgtaaccgggtttccgggacggaaacggggtacctaaaccgggttaggaacggttaccgaaaacgtaaccgtggtaacgcgttacgacctacctatccttacggtttcc

SEQ ID NO: 305534 - DNA, 622 bp, Homo sapiens
  misc_feature: GZ8MTXP02HQMPX.21.47.E03.1.454.CMB.2.raw
  modified_base (201)..(201): a, c, t, g, unknown or other
  misc_feature (201)..(201): n is a, c, g, or t
  modified_base (499)..(499): a, c, t, g, unknown or other
  misc_feature (499)..(499): n is a, c, g, or t
tcagtcgtcgctcgcacgaccggtgctcgatttagactcgcgcacagagagaagggggcaggagtcagacccagtaaggacacagcatggacatgagggtccccgctcagctcctggggctcctgctgctctggttcccaggttccagatgcgacatccagatgacccagtctccttcttccgtgtctgcatctgtagganacagagtcaccatcacttggtcgggcagtcagggtattagcaacgtggttagcctggtatcagacaagaaaccgaaggaaaacgaccccctaaatcctagactctatgctgacatccgagttgactaaaggtggtaccgtcccccgtactaaggttcaggcggcagggtgggtcgtagggacgtatttcaatctaccacatccaccgacgctcgacacgtctagaattatttcgactttaaactttatttaacgtttacgacctaaacgtacgtaccttaaacgtttcgttttacccncgttacgtaccgggttcgggaaccgggttaacgggacccgtaaacgggttcgggaacggttaaccaaaacggtacgttggtacggtaacgtacgacctaccgtattcgttcgttactttaccg

SEQ ID NO: 305535 - DNA, 615 bp, Homo sapiens
  misc_feature: GZ8MTXP02GXBD7.21.47.E03.1.454.CMB.2.raw
  modified_base (365)..(365): a, c, t, g, unknown or other
  misc_feature (365)..(365): n is a, c, g, or t
tcagtcgtcgctcgcacgaccggtgctcgatttagactcgcgcacagagagaagggggcaggagtcagacccagtcaggacacagcatggacatggagggtccccgctcagctccgtggggctcctgctgctctggttcccaggttccagatgcgacatccagatgacccagtctccttcttccgtgtctgcatctgtaggagacagagtccaccatcacgttggtcgggcgagtcaggggttattagctaacgtggtacgcctggtatcagcaagaaaccaggaaaacgcccctaaatcctgatctatgctgcatcctacgttgacgtaaaggtggaccgtcccgtataaggtcacggcggcgnggtgggtcgtggggaccgttattacaactcctacactactaccaccgtacgcctcgccgtacgaccgtaagtaacgttattttacgacttaaacctttatttacgttacgtaacctaaacgtacgtacctaaacgtttcgtttccttctacgtacggtcggtacgggacgggtaaccgtacggtacgggaacggtaaccgaaacgtaacgtggtaacggtcacggtactacctacgtccgtcgtttaccc

SEQ ID NO: 305536 - DNA, 663 bp, Homo sapiens
  misc_feature: GZ8MTXP02ISLOH.21.47.E03.1.454.CMB.2.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctggtagganacagagtccacctatcacgttggtcgggcgagtcgagggtatagctaagtggtanctgtancagacaagaaaccaaggaaaccncccctaaatcctagactctancgctagactactccgagttgaacgtaaaggtcggaccgtccccgtataacgggttcaggccggtcgtaggggttcggggtacgttagggggtaaccttacgtttacaaacttccgtacccgaaccctactacccaaccgacgtccctaggaccctagtacccgttaaggtaattacgttttacgaacctttaaactttagtttactacggtaaccaaacgtaacggtaccttaaacgtttccggttttccacttacggtaccggttcgggacgggtaacggtacccgtaaaggtacggtaaaccgtacgaaaaccggtcgtaggtccgactcgacctactacgttcttcgttacc

SEQ ID NO: 305537 - DNA, 605 bp, Homo sapiens
  misc_feature: GZ8MTXP02FNCLK.21.47.E03.1.454.CMB.2.raw
  modified_base (224)..(224): a, c, t, g, unknown or other
  misc_feature (224)..(224): n is a, c, g, or t
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgcggngagtcagggtatagcatggtagctgtatcagcaagaaaccaaggaaaacgcccctaaaactcctagatactatgctgcatcctacgttgacaaaggtggaccgtcccgtanaaggttcagcggactgggtgggtcgtaggggacgtatttacaaatctaccacctataccaaccncgacctgaccagacctagaaattacttttacgacttaaactttattatttacgtactaaacgacggtaccttaaaccttagttttccctacgttaccgtacgggtttaccggggaccgggtaaagggtacccgtaaacgggtaggaacggtaaccgtaaaacggtaacgtggtaacggtactcgaccgaactctcgtacgtttccc

SEQ ID NO: 305538 - DNA, 668 bp, Homo sapiens
  misc_feature: GZ8MTXP02H7F9X.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcaggggtattagcaacgtggtagcctggtatcagcaaggaaaccaaggaaaaccgcccctaaaactcctagatctatgactgctatccacgttgactaaaggtggaccgtccgtagaagtcagcggctaggtggggtctgggggacgtatttcgaaattcctaccaccactcccaccacgaccctgaccacgtccgtaaggtaacgttactttagacccttaaattttagtttaacgttacgtaaccgtaaacgtaacgttaccgttaaaaccgtttacggttttcccctaccgttaaccggttaccggggttaccggggtaaccggggaaaccgggtaacccggtaaacgggtacggggttaaacggtaaaccgtaaaaccggtaacggtggttaaccggacgttacggacctaaccgtctaccgtttcggttaccc

SEQ ID NO: 305539 - DNA, 594 bp, Homo sapiens
  misc_feature: GZ8MTXP02ICFJV.21.47.E03.1.454.CMB.2.raw
  modified_base (201)..(201): a, c, t, g, unknown or other
  misc_feature (201)..(201): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttgtcgggcagtcagggtattagcaactggtagctggtatcagcaagaaaccaggaaacgcccctaaactcctagatctatgctgcatccacgttgacaaagtggaccgtcccgtnaaggttcagcggcnggtgggctggggacgtntttacgaatctacaccatccactagccctgcacgacctagaacgtattttagacttaaacttatttattagttacaaacgtacggtacttaacttacgtttttacctacgttccgtacggttccgggtaccgggacggggacccgtaaacggttagggaacggttaccgtaaaaccggtaccgttaggtcgggtacttacggacccaacccgtatttaccgtcgtttccc

SEQ ID NO: 305540 - DNA, 770 bp, Homo sapiens
  misc_feature: GZ8MTXP02JALVL.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatccacttggtcgggcgagtcgaggggttattaggactaacgtggttagccttaggtatcagacaagaaaacccaaggaaaaccgtaccccctaaactcctagtactacgtatcgactgacctacttacccgtacgttgaaccgtaaaagggttcgggtaacccggttaccccccgtacgtaaaacggggtttcgaaacggccgggtacgtagggggttcgggttaccgggtagggggtaaccgtaagtttacaaacgttccctacgaaaccctacgtacccaaccgtaacgtcccgtacgacctaacggtcccgttaagtaaacggttactttttacggaacctttaaaacttttaacgtttacgtttaccgtaaccgtaaaaccgtaacggtaccctttaaaacgttaccgtttttaccctaccgttaccgtacgggttaccggggtaccggggtaaacgggtaacccgtaaacggggtacggtaaacggtaaaccgtaaaacgggtccgtaggttcggaccttacggaccctaacgtacgttcttacggtttccc

SEQ ID NO: 305541 - DNA, 572 bp, Homo sapiens
  misc_feature: GZ8MTXP02FXUXR.21.47.E03.1.454.CMB.2.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (344)..(345): a, c, t, g, unknown or other
  misc_feature (344)..(345): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagatcaccatcacttgcggcgagtcaggggtattagcaactggttancctggtatcagcaagaaaccaggaaaacgcccctaaacncctagatctatgctgcatccagttnacgaaagtggacgtccctgaagttcagcgnnggtggtctgggacgatttcaatctcacntcacngctgcagctgaagtctttagacttaaacttatttaattgtacaaacacggtacttaaacctagtttttcccacgttacgtaacggtttcgggacgggtacggggtaaacccaacgggtagggtaacggttaccgaaaaaccggtacgttacggtgggtcctacggtaccaaacctacgttccgttaacgtttcc

SEQ ID NO: 305542 - DNA, 741 bp, Homo sapiens
  misc_feature: GZ8MTXP02JPNQP.21.47.E03.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcaccatcacttgtcgggngagtcgagggtatagctaacgtggtacgctggtatcgagcaagaaaccgaggaaaacctcccctaaactcctagactctaatgctgacactccgacgttgacgaaaggtcggacccgtcccgtagtaacggttcaggccggcgtagggtggggtacgtgggggaccgttatttacgaaacttcccgtaccacctactcccaaccgcgtcccgtacgaccgtacgcccgttaagtaaacgttacgtttttacggaaacctttaaacttttagtttaacgttacggtaacccgtaaaacgttacggtaaacctttaaaccgtttccggtttttacccctccggtttaaccgttaacccgggggtttaccgggggtaaccgggggtaaaccggggttaacccggtaaacgggggttaccggggtaaacgggttaaacccgtaaaaaccgggttccgttagggggttcggtaccgttacggaccctaaccggttaactttacccggtttactttacccg

SEQ ID NO: 305543 - DNA, 622 bp, Homo sapiens
  misc_feature: GZ8MTXP02G7HXT.21.47.E03.1.454.CMB.2.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
  modified_base (360)..(360): a, c, t, g, unknown or other
  misc_feature (360)..(360): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagacgtcacctatcacgttgcgggctagtcgagggtattagctaactggtagcctggtatcagcaagaaacaggaaacncccctaaatctgatctatgctgactactcctagttgactaaaggtcgtaccgtcccgtagtaaggttcaggccggtanggggttggtcgtaggggacgtatttacgaatccgtacacatccacagcctgactcgactagtaaactntttacgacttaaagtttacttagtacgtaacctaagaccggttacttaaaccgttcgttttacccgtctaccggttacggtaccgggaacggggtaacggaacccgttaacgggtacggtacggtaaaccgtaaaccgaacggtttggaaccgggtacttacggacctaaccgtacgttaccgttcgtttaccc

SEQ ID NO: 305544 - DNA, 673 bp, Homo sapiens
  misc_feature: GZ8MTXP02G5GKG.21.47.E03.1.454.CMB.2.raw
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgaggggtattagctaacgtggtagcctggtatcagcaagaaaccaggaaacncccctaaatcctagatctatgctgcatccagttgacaaaggtgaccgtcccgtanaagtcagcgcgnggtgggtacgtggggacgtatttacaattcctacacataccaccgacgcctgaccacgtacctaggaaacttagttttacgaacctttaaaactttagtttaagttacgttaaccgtaaaacgtacggttaacctttaaaccgtttacgtttttacccctacgtttaccgtaaccgggtttccggggaaccgggtaaaccggggtaacccgttaaacggggttacggggtaaaccggttaaacccgaaaaaccgggttaccgttagggtaaccggtaaccgttcggaacccgtaaccgtaactttccgtttacgtttacccg

SEQ ID NO: 305545 - DNA, 584 bp, Homo sapiens
  misc_feature: GZ8MTXP02H9Y3T.21.47.E03.1.454.CMB.2.raw
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacgttgtcgggcgagtcgagggtatagactaacgtggtagctggtatcagacaaacgaaacctaaggaaaaccgtcccctaaactcctagacttctatcgctgcactccgtacgttagactaaaggtcggaccgtcccgtagtaacggttcacggcggactggggttcgggtcgtggggtacgtattacatctacactactcacganctagcacgtcgtagagtntttcgaacttaactttattatcgtacaacgtacgtacttaacttcgtttcctcgttacgtacggttcgggacggtacggtacctacggggttacggaacgtacgaaaacgtcgtggtgcctgaccgtactacgtctttcgttac

SEQ ID NO: 305546 - DNA, 613 bp, Homo sapiens
  misc_feature: GZ8MTXP02JR8RM.21.47.E03.1.454.CMB.2.raw
  modified_base (404)..(404): a, c, t, g, unknown or other
  misc_feature (404)..(404): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaacgtggtagcctggtatcagacaagaaaccaggaaaacgcccctaaatcctagatctatgctgacactccgacgttgacgaaaggtcgaccgtccccgtagaaggttcaggcgacgtgggtcgggtctggggacgtatttacatcacactatcaccagtcngcagtcctagaagtatttacgacttaaactttattatttacgtacaaacgtacggtaccttaaaacgttcgttttaccctacgttacgtaccgggttacgggtacggggaaacggtacccgaaacggggttaggaacgggttaaccgtaaaacccggtacgttaggtccggacgttacggaccctaaactacgtttcgtcgtttacccg

SEQ ID NO: 305547 - DNA, 610 bp, Homo sapiens
  misc_feature: GZ8MTXP02H4S1L.21.47.E03.1.454.CMB.2.raw
  modified_base (434)..(434): a, c, t, g, unknown or other
  misc_feature (434)..(434): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttggtcgggcgagtcgagggtattagcaactggtagccgtggtatcagacaagaaaccgaaggaaaaccgcccctaaactcctagactctatgctgcatccagttcgacaaaggtggaccgtcccgtagtaaggtcaggcggacgtggtggggtacgacggggtacgtatttacgaaattcctacaccatccacctagccctgcagcctagaagttntttacgacttaaacttatttagtcgtaacaaacgtacggtaccttaaacgttacgtttccctcgtaccgtacgggttacggggacgggtacgggaccctaaaggttagggaacggttaccgaaaacggtacgttcggaaggtactacggacctaaaccgtcgttcttacgtttacc

SEQ ID NO: 305548 - DNA, 639 bp, Homo sapiens
  misc_feature: GZ8MTXP02JFIKM.21.47.E03.1.454.CMB.2.raw
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtcctccttcttccgtgtctgcatctgtaggagacagagtcacctatcctacgttgtcgggcgtagtcgagggtattaggcaagtggtancctggtatcagcaagaaaccaggaaaacncccctaaaatcctagactctatgctgacactccacgttgactaaaggtgaccgtcccgtagtaacggtcaggcggataggggtcgggtcgagggggtacctatttaccaaacgtcctaccacctactcaccacgcctcgacagccctaggaagttatttacgacttaaactttagttaacgttacgtaaccgtaaacaacggtaccttaaaaccgttcgttttacccctactaccggttaacgtccggggaacgggtaacggtaaccgtaacgggtagggaaacgtaaccgtaaaacgtaccggtaggttaacggaccgttcggaacctacggtactttctacggtttacc

SEQ ID NO: 305549 - DNA, 603 bp, Homo sapiens
  misc_feature: GZ8MTXP02FKUWT.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtccaccatctacttggtcgggcgagtcgaggggttattagctaacgtggttacgcctggtatcgaagcgaaagaaaccgaaggaaaacgccccctaaatcctagatctatgctcgctactcctacgtgaactaaaggtggacccgtcccgtataaggtcaggcggcgtagggtggggtactaggggacgtatttacgaaattccgtacacctactaccacacgcctagctacgtcctagaattatttacgacttaaactttattagttagactaaacgtacgtacttaaacttcgtttcccactacgtacggttcgggacgggtacggtaccgtaacggtagggaacgtacaaaaccggagttggaacgtctacgacaacgtctacttcgttaccc

SEQ ID NO: 305550 - DNA, 790 bp, Homo sapiens
  misc_feature: GZ8MTXP02JMINO.21.47.E03.1.454.CMB.2.raw
  modified_base (106)..(106): a, c, t, g, unknown or other
  misc_feature (106)..(106): n is a, c, g, or t
  modified_base (231)..(231): a, c, t, g, unknown or other
  misc_feature (231)..(231): n is a, c, g, or t
  modified_base (268)..(268): a, c, t, g, unknown or other
  misc_feature (268)..(268): n is a, c, g, or t
tcagtcgtcgctcgcacgaccggtgctcgatttagactcgcgcacagagagaagggggcaggagtcagacccagtcaggacacagcatggacatgagggtccccgntcagctcctggggctcctgctgctctggttcccaggttccagatgcgacatccagatcgacccagtcctccttcttccgtgtctgcatctgtaggagacagacgtcactatctacgttggcgggnagtcgagggtattagctaagtggtacgccgtggtacncgagacaaacgaaaccgaggaaaaccgtcccctaaactcctagattctagtgtactcgacctacgtaccgtaggttacgaacgtaaaggttcggaacccgtttccccgtaagtaacggtttccgacggtaccggagtaggggttcggggtactacgggggtattacttaccgaaattcccgtaacccacccgtaaacgtacccgaaacccgtacggtacccttaggacctaaccggtaccgttaaggttaaaaccgtttacgttttaaaccggtaaacctttaaacgttttacgttttaaacgtaccgtaaaccgtaaaacggtaccgtttaaaaccgttttaacgtttaaccgggtttttcccccaggtttaacccggtaaccggggtttaccggggaaacggggttaacccggggtaaaacctaaacgggggttacgggtaaaaccgtaaaaccgtaaaacggttacgtgggtaaccggtaacgtacggaccctaaccgtcgtttaccgtaactttcccg

SEQ ID NO: 305551 - DNA, 838 bp, Homo sapiens
  misc_feature: GZ8MTXP02G98MJ.21.47.E03.1.454.CMB.2.raw
tcagtcgtcgctcgcacgaccggtgctcgatttagactcgcgcacagagagaagggggcaggagtcagacccagtcaggacacagcatggacatgagggtccccgctcagctcctggggctcctgctgctctggtttcccaggttccagatgcgacatccagatcgacccagtctccttcttccgtgtctgcatctgtaggagacagacgtcaaccatctacgttggtcgggacgtaggtcgaaggggttattagacctaacgttggttacgccttaggtatcgagacaaacggaaaaccaaggaaaaccgtacccctaaactccgtagacttactaagtcgtacgtgacctacgttccctaggtttacgacgtaaaaggttcgggaaccccgtccccgtataaacgtacgtttcgaaggtccgggtacggtagggttcgggggtccggttagggggtaccgttattttaccgaaactttcctacccgtaaaccctactaccaaacccgtacggtccccgtggaccgtaaaccgggttacccgttaaaagggttaaacgtttaacgttttttaccggaaaccctttaaaacggttttttactttaagttttaacccggggaaacctaaaaaccggtttacggggttaaaccctttaaaacggtttaacccggttttttccccaacggtttaccggttacccgggggtttaacggggacccggggttaaacggtaaacccggttaaaagggtcggggtaaacccgttaaaacgaaaacccggtttaggtcggtttaacggccttacggtaacccgttaccctaagtttccggtttaccg

SEQ ID NO: 305552 - DNA, 669 bp, Homo sapiens
  misc_feature: GZ8MTXP02GR75W.21.47.E03.1.454.CMB.2.raw
  modified_base (200)..(200): a, c, t, g, unknown or other
  misc_feature (200)..(200): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtagganacagagtcaccatcacttgcggcgagtcaggggtattagcaactggtagcctaggtatcagcaacgaaaccgaaggaaaaccgtccccctaaatcctagactactatgctgcactccgaccgttagaacctaaaggtggacccgttcccgtacgtaaacgggttcaggcggcgaggggtcggggttcgacgggggtaacgttacgtttacaaacgttcctaccaccgtactaccgaaccgaccgcccgtacgacctaacgtacccgtaagtaaagtttacttttacggtaccttaaaactttatttacgttacggttaaacctaaacgtaaccggttaacttaaccgtttacgttttacctcgttaccgtaacggttccgggacgggtaaccgggaacgtaacgggtagggaaccggttaacaaaacgtacggtggttaaggactacgaccgtactacgtcgttacttc

SEQ ID NO: 305553 - DNA, 656 bp, Homo sapiens
  misc_feature: GZ8MTXP02HNLNQ.21.47.E03.1.454.CMB.2.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttctccgtgtctgcatctgtaggagacagagtcaccatctactgtcgggcagtcagggtattaggcaactggtaacncctggtaacncagacaaagaaaccgaaggtaaaacctacccctaaactcctagacttacagtcgctagacctactccgaagttagaacgtaaaggtcggacccgtacccgtagtaagtcgaggcggagtacgggtcggggtacgtacggggacgtatttacgaacttcccacaaccactaccaccgtcgccctgaccagtcgtaagtaacgttactttacgaacttaaatttagttagtactaaccgaaagtacggttaacttaaaccgttacgtttcccttacgtaccgtaaccgggttacggacggggtaaaccggaaccgtaaacggtacgggtaaaccgttaaacgaaaaccggtacgtacggtaacgactacgtacctaacgtacttacgtttacgtcg

SEQ ID NO: 305554 - DNA, 746 bp, Homo sapiens
  misc_feature: GZ8MTXP02JJGGP.21.47.E03.1.454.CMB.2.raw
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctactctggttcccaggttccagatgcgacatccagatcgacccagtcctccttcttccgtgtctgctatctggtagganacagagtaccaccatctacgttggtcgggcgtagtcgagggttattacgctaacgttggtacnccgtaggtactacgagacaaacgaaaccgaaagggaaaaccctacccccttaaaagtcccgtagtaactactagtcggtactacgacctaacgtaccgtaacggttacgaaacgtaagggtcggtaccgttaccccccggtagtaacgggttccaacgggtccggacgttacggggtcgggggtaccgtaagggggtaccgtttaacgttaccaacgtttccgacccaaacctctaccccgaacccgtaccgtacccgtgacctaccggtaccgtttaaagaagtttacgtttactaaaccgtttaaactttagttacgttaccgaaacaaccggtacggtaactttaacccgtttacggtttaccctacgtacggtacccgggttcggggaaccgggtaacggtaaaccgtagggtacggaaaccgttaacaaacggtacgttggacgtcacggacctactagttctacgtcttacc

SEQ ID NO: 305555 - DNA, 677 bp, Homo sapiens
  misc_feature: GZ8MTXP02HJEL7.21.47.E03.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagacgtcaccatcacgttggtcgggcgagtcgagggtattagcaacgttggtagcctggtatcagacaagaaaccaggaaaaccgcccctaaatcctagactctaangctgctatccagttgacaaaggtcggacctcccgtagaacggttcaggcggctaggggttggggtccgtagggggtaccgttatttacgaaacttccctaccaacctactaccaccgagccctacgaccacgaccgtagtaaagttacttttacgaacctttaaactttaactttattacggtaactaaacgtacggttaccttaaaccgttacgtttttccctacgttaccggttacggttccggggtaacgggtaccggggtaaccgtaaacggggtacggggtaaacggtaaacgtaaaaaacggtaccgttagggtaaccggtacgtacggtaccctaactacgttccgtttacgtttacccg

SEQ ID NO: 305556 - DNA, 704 bp, Homo sapiens
  misc_feature: GZ8MTXP02IWNKR.21.47.E03.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (673)..(673): a, c, t, g, unknown or other
  misc_feature (673)..(673): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtagganacagagtcacatctacgttggtcggngagtcgaggggtattagctaacgttggtacgcctggtaactcgagacaaacggaaaaccaaggaaaacccgtacccctaaaactccgtagtaacttctaagtcgtacctagacctactacccgtaacgttagaacgaaaaggtcggaaccgttacccccgtacgtaaacggttcgacggtaccggtacgtagggggttcgggtacggtagggggtaaccgttactttaccgaaagttccctaaccgaacctaaccgttacccaaccgtaacgtcccgtaggaccgtacggtacccgtaagtaaacgttattttaacggaacctttaaactttatttaacgtacgtaccaaagtacgtactttaaacgtcgttttccacgttacgaccggttacggaacgggtacggtaccgtaacgggtacggaacggtaaccaaacggttacggngtaacgctacgactacgtacttcgttacgtc

SEQ ID NO: 305557 - DNA, 718 bp, Homo sapiens
  misc_feature: GZ8MTXP02IV73R.21.47.E03.1.454.CMB.2.raw
  modified_base (256)..(256): a, c, t, g, unknown or other
  misc_feature (256)..(256): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacgttggtcgggcgagtcgagggtattagcaacgttggtanccgtggtactcgagacaacgaaaaccaacggaaaaccgtcccctaaactccgtagactactatcgactgactactacctacggttagaaccgtaaaggtcggtaacccgtaccccgtacgtaaacggttcgacggccggtcgtagggggttcgggggtacggtacgggggtaaccgttagtttaccaaacgttcccgtacctaacccaacttacccgaaccgacgtcccgttacgaccgtaacgtcccgttaaaggtaaacgtttattttacggaacctttaaacctttattttaacgttacgtaaccgtaaaacgtacggttaacctttaaacgttcgttttaccctacgttaccgtaacgggttcgggacgggtaacggaccgtaacggtacggtaacgtaaaccgtaaacgtaacgtggtaacggctacggacctaacgtacttaccgttcgtttaccg

SEQ ID NO: 305558 - DNA, 546 bp, Homo sapiens
  misc_feature: GZ8MTXP02FF449.21.47.E03.1.454.CMB.2.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcagtcagggtatagcaactggtagcctggtatcagcagaaaaccaggaaaagccccctaaaatcctgatctatgctgcatccacgttgcaaagtggacgtcccgtnaaggttcagcgcngtgggtctggggacgatttcaatctcaccatcaccagccctgcagcctgaaacgtattttagaaactttattattgtacaaacaggacctaaactacggtttttacctctacaacggtttcggacgggtacggggaaccaaacggtagggaacggttacaaaaccgtaactgtacggcttggccaccgatctcgtctttacc

SEQ ID NO: 305559 - DNA, 726 bp, Homo sapiens
  misc_feature: GZ8MTXP02IAFA7.21.47.E03.1.454.CMB.2.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatcgacccagtctccttcttccgtgtctgcatctagagganacagagtcacatcacgttgcgganagtcaggtatagcaacgtggtanccgtagtancagacaagaaaccaaggaaaaccncccctaaatccgtagactactaatgctagctactccgagttgaaccaaaggtcggtaaccccgttcccccgtaagtaacggttacgaacggtcccgggtataccggggttgggttaccggacggggttacccgttaattttaaccgaaactttcccaaccgttaaaccaacggttaccccaaacccgacggtccccgttaacgaccgtaacgtaacctttaaagtttaaacgtttacgaacctttaaatttacttacgtaacgtaaactaaacgtacgttaacttaaccgtttcctttacccgtcgtaccggttacggggtaccggaacggtacggtaacccgtaagggtaacggtaaaccggtaaaccgtaaaaccgtcggttcggtaacgtaacccgtacgaacccgttaccgtactttaccggttacctttaacccgtccg

SEQ ID NO: 305560 - DNA, 595 bp, Homo sapiens
  misc_feature: GZ8MTXP02FNJQ6.21.47.E03.1.454.CMB.2.raw
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (478)..(478): a, c, t, g, unknown or other
  misc_feature (478)..(478): n is a, c, g, or t
tcagtcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcggcgagtcagggtatagcaatggtagctggtatcagcaagaaaccaaggaaaacgcccctaaaactcctagatctatgctgacatccacgttgactaaaggtggacctcccgtanaaggttcagcggacngggtcgggtacgtggggacgtatttacgaattcctaccaaccatccaaccgacgccctgccagcctagatatttagactaaattattattacgtacaaagtacgtacttaaacgttcgttttaccnccttaccgtacggttcgggacggacgggtaacctaacgggtacggaacggtaacgaaaaacggtaccgttaggtaacggtactacggtacctaccgtaacgtcgttacgtttacccg

SEQ ID NO: 305561 - DNA, 540 bp, Homo sapiens
  misc_feature: GZ8MTXP01BYWK2.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaaacgccccccaaaactccctcatttatgaggtcactaagcggcccttagggggtcccctgatcgcttctctggcctccaagtctggcaagaaccggcctccctgacccgtctcgtggggctccaagctgaggatgaggctgtattattactgcagctcatatgcaggcagcagctaatgtacgttttcgggcggtagggaccaaagcgtaggaccgttcgttgggttcaagcccaaggcctcggcccctcggttcctaacc

SEQ ID NO: 305562 - DNA, 532 bp, Homo sapiens
  misc_feature: GZ8MTXP01EF9F1.2.35.D02.1.454.CMB.2.raw
  modified_base (441)..(441): a, c, t, g, unknown or other
  misc_feature (441)..(441): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaaacgccccccaaaactcctcatttatgaggtcactaaagcggcccttagggggtccctgactcgcttctctggcctccaagtctggcaagaacggcctccctgacccgtctctgggcttcccaagctgaggatgaggactgtattattactgcagctcatatncaggcagcagcaaatgtaacttttcgggcggaggggaccaaagcgtgaccgttcgttgggttcaagcccaaggctgcccctggttctaacc

SEQ ID NO: 305563 - DNA, 524 bp, Homo sapiens
  misc_feature: GZ8MTXP01EJLA3.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaagccccccaaaactccctcatttatgaggtcactaagcggcccttagggggtcccctgatcgcttctctggccctccaagtctggcaagaacggcctccctgacccgtctctggggctccaagctgagatgagctgattatactgcagctcatatgcaggcagcagcaatgtactttcggcggagggaccaagctgaccgttccgttgggttcaagcccaaggctcgcccctcggttctaacc

SEQ ID NO: 305564 - DNA, 586 bp, Homo sapiens
  misc_feature: GZ8MTXP01DQKFJ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctctatttatgagtcactaagcggcccgttaggggtccctgactcgcttctcgtcggccctccaagtcgtggcaaacggaaccggccctcccgtcgtacccgtctcgtcgggctaccaagctaggaggatgaggtctagtattattactgcagcctagatatgcgaggcagcaagctaaattcggttaacgtttcggggaacggaacgggaccaaaggttcgtacggtcccgttacgttcggggttaccaacggacccgaagggtcctccggcccccttcggttccttaacccg

SEQ ID NO: 305565 - DNA, 535 bp, Homo sapiens
  misc_feature: GZ8MTXP01AZRB7.2.35.D02.1.454.CMB.2.raw
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccccggcgaaacgccccccaaaactccctcatttatgaggtcactaagcggccccttagggggtcccctgatcgcttctctggcctccaagtctggcaagaacggcctccctgacccgtctctggggctccaagctgaggatggaggctgattagtactgcagctcgatatgcaggcagcagctaaatgtactttcgggcgtagggaccaagcgtgaccgttcgttgggttcaagcccaagggctcgcccctcggttctaaccg

SEQ ID NO: 305566 - DNA, 530 bp, Homo sapiens
  misc_feature: GZ8MTXP01EWE8M.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctcatttatgaggtcactaagcggcccttagggggtcccctgactcgcttctctggcctccaagtctggcaagaaccggcctccctgacccgtctctgggctccaagctgagatgaggctgattattactgcagctcattaagtgcaggcagcagctaaatgtacgtttggcggtagggacaagcgtgaccgttcgttgggttcaagcccgaagggctcgcccctcggttcgtaaccg

SEQ ID NO: 305567 - DNA, 537 bp, Homo sapiens
  misc_feature: GZ8MTXP01CCEKU.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctcatttatgaggtcactaagcggcccttagggggtccctgactcgcttctctggccctccaagtctggcaagaaccggcctccctgacccgtctcgtcgggctccaagctgaggatgaggctgatttatactgacagctcgatatgcaggcagcagctaatgttactttgggcggagggaccaagcgtgacccgttcgttgggttcaacggcccaaggccctcgcccccgtcggttcctaaccg

SEQ ID NO: 305568 - DNA, 622 bp, Homo sapiens
  misc_feature: GZ8MTXP01EALX6.2.35.D02.1.454.CMB.2.raw
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtaatcaacaacacccgcgaacgacccccaaactcctcatttatgagtacactacgcggcccgttagggggtccctgtactcgcttctctggcctccagtctggcaaacgacggcctccctgaccgtcgtctacggggcttacccaagctgaaggactggngactgtattatttacgngacatctactatatcgacgacggcgagacgaacgtacgtaacgtacggtttaccggtttaccggggaacgggtaacgggttaacccgaaacgttccggtaccgggtacccgttccggttcgggttcccgtaaccggcccggtaaccggtcccgttccccgttacccccggttccggttccgtaacccg

SEQ ID NO: 305569 - DNA, 569 bp, Homo sapiens
  misc_feature: GZ8MTXP01D340Y.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaaacgccccccaaactcctcatttatgaggtcactaagcggtccccgttagggggtccctgactcgcttctctggccctccaagtctggcaagaaccgccctccctgacccgtctcgtgggctccaagctgaggatgaggctgtattattactgcagctacatatgcaggcagcagctaaagttgttacgtttcgggaacggtaacgggaccaaggttcgtcggtaacccgttccgttgggttaccaacggcccgaacggtcctccggcccccgttcggttccgtaacccg

SEQ ID NO: 305570 - DNA, 541 bp, Homo sapiens
  misc_feature: GZ8MTXP01A9AN1.2.35.D02.1.454.CMB.2.raw
  modified_base (302)..(302): a, c, t, g, unknown or other
  misc_feature (302)..(302): n is a, c, g, or t
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaaacaacaccccggcgacgcccccaaactcctcatttangaggtcactaagcggcccgttagggggtccctgactcgcttctctggcctccagtctggcaagaacggcctcccgtgacccgtctcgtgggctccaagctgaggatgaggctgtattattactgcagctcattangcaggcagcagctaatgtacgtttcggnggacgggactaaagcgtgtaaccgttccgttgggttccaacgcccaagggcctcggccccctcgggttctaacccg

SEQ ID NO: 305571 - DNA, 522 bp, Homo sapiens
  misc_feature: GZ8MTXP01A5XBD.2.35.D02.1.454.CMB.2.raw
  modified_base (476)..(476): a, c, t, g, unknown or other
  misc_feature (476)..(476): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcccggtatcaacaacaccccggcgaacgcccccaaactcctcatttatgaggtcactaagcggcccttagggggtccctgatcgcttctctggctccccaagtctggcagaaaccggcctccctgaccgtctctgggctcaagctgaggatgaggctgattatactgcagctcatatgcaggcagcagcaatgttacttttcgggcggaaggggaccaagcnggaccgtcttggggttcagcccgagctcgccccnggtcncgttccc

SEQ ID NO: 305572 - DNA, 551 bp, Homo sapiens
  misc_feature: GZ8MTXP01DY2YV.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaaacgccccccaaactcctcatttatgagtcactaagcggcccttagggggtccctgatcgcttctctggcctccaagtctggcaacgaacgcctccctgaccgtctcgtgggctccaagctgaggatgaggctgtattattactgcagctcatatgcgaggcagcaagctaaattcgtacgttttcgggaacggtagggaccaaggcgtacggacccgttccgttggggttccaacggacccgaacggcctccgccccgtcggttcctaaccg

SEQ ID NO: 305573 - DNA, 566 bp, Homo sapiens
  misc_feature: GZ8MTXP01BF53D.2.35.D02.1.454.CMB.2.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
  modified_base (421)..(421): a, c, t, g, unknown or other
  misc_feature (421)..(421): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctcctggtatcaacaacaccccggcgaaacgcccccaaactcctcatttangaggtcactaagcgccttaggggtccctgatcgcttctctggcctccagtctgcaagaaccggcctccctgacccgttctcgtcggggctcccgaagctaggaggatgagtctgattntactgcagtctagatatcgacgagcagacagtactaagttcgttacgttcgggaacgggaacggaccgtaagccgtacggtaccgttcggttcgggttaccaacggacccgtaacgcccgtccgttccccgtccgttcctaaccg

SEQ ID NO: 305574 - DNA, 581 bp, Homo sapiens
  misc_feature: GZ8MTXP01DDIT3.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (433)..(433): a, c, t, g, unknown or other
  misc_feature (433)..(433): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttanaactntgtctcctggtatacaaacaacaccccggacgaaacgaccccccaaaactcctcaatttactgaggtcactaagcggcccttaggggtccctgactcgcttctctggcctccaagtctggcaaagaacggccctccctgacccgtctcgtgggctccaagctgaggatgaggctgatttattacgngcagtctagtatagtcgacgaggcagcgtaagactaagttcgttacgttcgggaacgggtaacggaaccgaacggcgtacggtaccgttccggttcgggaccaacgacccgtaacggcccgtcccgttccccgttcggttcctaaccg

SEQ ID NO: 305575 - DNA, 557 bp, Homo sapiens
  misc_feature: GZ8MTXP01AOXBF.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgcccccaaactcctcatttatgaggtcactaagcggcccgttaggggtccctgactcgcttctctggccctccaagtctggcaagaaccggccctcccgtgacccgtctcgtcgggcctaccaagctggaggactggaggtctgtattacttactgcagctacgatatgcaggcagcagctaattcgtacgtttcgggaacggtagggacctaaggcgtcgtaccgttccgttgggttcaacgcccgaacggcctccggcccctcggttcctaacccg

SEQ ID NO: 305576 - DNA, 547 bp, Homo sapiens
  misc_feature: GZ8MTXP01AQ6QO.2.35.D02.1.454.CMB.2.raw
  modified_base (471)..(471): a, c, t, g, unknown or other
  misc_feature (471)..(471): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaaacgcccccaaaactcctcatttatgagtcactaagcgcccgttaggggtccctgactcgcttctctggcctccaagtctggcaagaacggcctcctgacccgtctcgtcgggctccaagctgaggatgaggctgattagtactgcagtctacatactgcaggcagcagctaatgtaacgtttcggaacggngggacccaaagcgtacggtacccgttcgttgggccaacgcccgaaggtcccgtcgcccccgtcggttcctaacccg

SEQ ID NO: 305577 - DNA, 557 bp, Homo sapiens
  misc_feature: GZ8MTXP01CFR4O.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgccccccaaactcctcatttatgagtcactaagcggcccttagggggtccctgatcgcttctctggccctccaagtctggcaagaaccggcctccctgacccgtctcgtcggggctccaagctgacggatgaggctgtattattactgcagctacatatgcaggcagcagctaaattgttacgtttcgggaacggtaacgggaccaagcgtacgacccgttccgttgggttccaacggcccgaaggtcctccggcccccgtcggttcctaacccg

SEQ ID NO: 305578 - DNA, 516 bp, Homo sapiens
  misc_feature: GZ8MTXP01AOE52.2.35.D02.1.454.CMB.2.raw
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaagccccccaaaactcctcatttatgaggtcactaagcggcccttagggggtccctgatcgcttctctggcctccaagtctggcaagaacggcctccctgaccgtctctgggctccaagctgagatgaggctgattattactgcagctcatatgcaggcagcagcaatgtactttcggcggtagggccaagcgtgaccgttcgngggttcngccaaggctcgcccctcggttctccg

SEQ ID NO: 305579 - DNA, 557 bp, Homo sapiens
  misc_feature: GZ8MTXP01ESQO7.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcctccgggtctcctggacagtcagtcaccatctcctgcactggagcagcagtgacgttggcgttataactatgtctctggtatcaacaacaccccggcgaacgcccccaaactcctcatttatgaggtcactaagcggtcccgttaggggtccctgactcgcttctctggcctccaagtctggcaagaaccggccctcctgacccgtctcgtgggctccaagctgaggatggaggtctagtattattactgcagtctacgatagtgcaggcagcagctaattgttacgtttcgggcgggaggaccgaagttcgtacggtacccgttcgttgggttccaacgcccgaacggtccgtccgcccccgtcgggttccctaaccg

SEQ ID NO: 305580 - DNA, 625 bp, Homo sapiens
  misc_feature: GZ8MTXP01AVWC7.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaaacgccccccaaactccctcatttatgagtcactaagcggcccttaggggtccctgactcgcttctctggccctccaagtctggcaaacgaaccggccctcccgtgacccgtctcgtcggggctccgaagctaggaggatgagggtctgtatttagttactgctagtctacgtaatagtgaccgagggcagccaaggtacctaaagttcgtttaacggttttccgggaacgggtaacgggaaccgtaaacggccgttacgggaacccggttccggtttcggggacccaacgggtccccgaacgggtcccgtacccggccccccgttcggttaacccgttaaccccg

SEQ ID NO: 305581 - DNA, 569 bp, Homo sapiens
  misc_feature: GZ8MTXP01A82KI.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggacgaaacgaccccccaaactccctactatttatgaggtacacgtaagccggtcccgttagggggtcccctgactcgtcttctcgtggccctccaagtctgggacaacggaaccggccctccctgacccgtctcgtcgggctaccaagctaggaggatggaggctagtatttatactgcagtctagatagtgcgaggcagcagctaagtgttacgtttgggaacggtacggactaagcgtacggccgttcgttgggttccaagcccgaagggcctccgccccgtcggttcctcccg

SEQ ID NO: 305582 - DNA, 568 bp, Homo sapiens
  misc_feature: GZ8MTXP01D6CG7.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgccccccaaactcctcatttatgaggtcactaagcggcccttaggggtccctgatcgcttctctggcctccaagtctggcaaacgaaccgcctccctgacccgtctcgtgggctccaagctgaggatgaggctgattatactgcagcttcatatgacaggcagcagctaaagttgttaacgttttcgggaacggacgggacccaaaggttcgtacggtacccgttccgttcgggttaccaacggccccgaaagggtcccgtcggcccccgttcgggttccgtaacccg

SEQ ID NO: 305583 - DNA, 547 bp, Homo sapiens
  misc_feature: GZ8MTXP01CHAG4.2.35.D02.1.454.CMB.2.raw
  modified_base (249)..(249): a, c, t, g, unknown or other
  misc_feature (249)..(249): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctcctggtatcaacaacaccccggcgaacgccccccaaactccctctatttatgaggtcactaagcggccccttagggggtccctgatcgcttctctggcctccagtctggcaagaaccggcctccctgaccgtctctggggctccaagctgaggatggaggctgattattactgcagctcgattatgacaggcagcagctaatgttactttgggaacggtaggaccaagcgtacggacccgttcgttgggttccaagccccgaaggccctcggcccccttcggttcctaacccg

SEQ ID NO: 305584 - DNA, 545 bp, Homo sapiens
  misc_feature: GZ8MTXP01CH7RQ.2.35.D02.1.454.CMB.2.raw
  modified_base (502)..(502): a, c, t, g, unknown or other
  misc_feature (502)..(502): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaaacgccccccaaactcctcatttatgaggtcactaagcggtccttaggggtccctgatcgcttctctggcctccaagtctggcaagaaccggccctccctgacccgttctcgtgggctccaagctggagatgaggtctagtaattagttactgacagtctcgattatgcaggcagcagctaatgtacgtttcggcggtagggaccaagcgtacgaccgttccgngggttccaaggcccgaaggcctacgcccccgtggttcctaacc

SEQ ID NO: 305585 - DNA, 557 bp, Homo sapiens
  misc_feature: GZ8MTXP01BRVE6.2.35.D02.1.454.CMB.2.raw
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaacgccccccaaaactccctcaattttatgaggtcactaagcggcccttagggggtcccctgatcgcttctctggcctccaagtctggcaagaacggcctccctgaccgtctctgggctccaagctgagatgaggctgattatactgcagctcgatatgcaggcagcagctaaagttgtaacgttttcgggcgggtacgggaccaaagcgtcgaacccggttccgttggggttcaacggccccgaaggccgtcgcccccgttcgggttccctaacccg

SEQ ID NO: 305586 - DNA, 520 bp, Homo sapiens
  misc_feature: GZ8MTXP01B8WRH.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaaacaacaccccggcgaaacgccccccaaaactcctcatttatgaggtcactaagcggcccttagggggtccctgatcgcttctctggcctccaagtctggcaagaaccggcctccctgaccgtctctgggctcaagctgagatgaggctgattatactgcagctcgatatgcaggcagcagctaatgtactttggcggaggaccaagcgtgaccgttccgttggcaagcccaaggctcgcccctcggttctaacccg

SEQ ID NO: 305587 - DNA, 519 bp, Homo sapiens
  misc_feature: GZ8MTXP01BV75Y.2.35.D02.1.454.CMB.2.raw
  modified_base (376)..(376): a, c, t, g, unknown or other
  misc_feature (376)..(376): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaagcccccaaaactcctcatttatgaggtcactaagcggccccttagggggtcccctgatcgcttctctggcctccaagtctggcaagaacggcctcccngaccctctctgggctccaagctgagatggaggctgattattactgcagcttcatatgcaggcagcagcaatgtaactttcggcggtggacccaagcgtgaccgttcgttgggttcaagcccaaggctgccccctggctaaccg

SEQ ID NO: 305588 - DNA, 646 bp, Homo sapiens
  misc_feature: GZ8MTXP01DD72S.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttaataactatgtctctggtatcaaacaacaccccggacgaacgacccccaaactcctactatttangacggtcactaagcggacccttaggggtccctgactcgcttctctcggccctacaagtctggacaaaggaaccggccctcccgtgacccgttctcgtcggggcctacccgaagcgtaggaaggagtggacgggtcttagtaatttaagttacttgacagtcctacgtaattaagtgacgaagggcctaaggactaaggacctaaagttacggtttaaccgttttcggggaacggtaaacgggggacccaaaggttccgtacggtaacccggttcccgttcgggaccgaacggccccgaaacgggcccgtccggttccccccgttcgggttcccgtaacccg

SEQ ID NO: 305589 - DNA, 539 bp, Homo sapiens
  misc_feature: GZ8MTXP01BHGAY.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaacgccccccaaactcctcatttangaggtcactaagcggcccttagggggtcccctgatcgcttctctggccctccaagtctggcaagaaccggcctccctgacccgtctcgtgggctccaagctgaggatgaggctgattatactgcagctcgatatgcaggcagcagctaagtgtacgtttcgggcgggtaggaccaaagcgtgaccgttcgttgggttacaacgcccgaaggcctccgcccctcggttctaaccg

SEQ ID NO: 305590 - DNA, 532 bp, Homo sapiens
  misc_feature: GZ8MTXP01BRTR8.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaacgccccccaaactcctcatttatgaggtcactaagcggcccttagggggtcccctgatcgcttctctggcctccagtctggcaagacggcctccctgaccgtctctggggctccaagctgaggatggaggctgatttattactgcagctcgatagtgcaggcaggcagctaatgttacgtttcgggcggtagggaccaagcgtgaccgttcgttgggttcaagcccaaggcctcgcccctggttcctaaccg

SEQ ID NO: 305591 - DNA, 614 bp, Homo sapiens
  misc_feature: GZ8MTXP01D39V5.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtcctcctggacagtcagtccaccatctcctgcacgtggagcagcagtgacgttggcgttaatactatgtctctgtatcaacaacaccccggacgaacgacccccaaactcctacatttangaggtcacgtaagcggtacccgttaggggtcccctgactcgtcttctcgtggcccctaccgaagttcgtggccaaacggaacccggtccctccccgtgacccgttctcgtcgggctaccaagctgaggatggagtctagtattatactgcagctacattatgacgaggcagcaagcctaaagttcgttacgtttcgggaacgggtacgggacgaaacggttcgtacggtacccgttccggttgggttacccaacggaccccgaacgggtcccgtcccggttcccccgttcggggttcccttaaccccgg

SEQ ID NO: 305592 - DNA, 802 bp, Homo sapiens
  misc_feature: GZ8MTXP01CEKUA.2.35.D02.1.454.CMB.2.raw
  modified_base (251)..(251): a, c, t, g, unknown or other
  misc_feature (251)..(251): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtgacgttggcgttaataactntgtctctggtatcaaacaaccaccccggacgaaaccgacccccaaactccctactaatttatcggaacggtcaacgtaaacgccgggtaccccgtttaacgggggtcccctgacttccggtctttcctcgtcggccccttaccgaaagttcgtacgggaccaaaacgggtaaacccgggtccccttcccgtacgggtaccccgttccgttccggttcggggacccttaccccgaaagtcccgttagggaacgggacgttagggaacgggtccgttaggttaagttttaactttaacccgttgtaaccgaacggtcccgtttacgtaacttttaaagtcggaacccggtaaagggcccgaaaggaccgttaaaggacccgtaaagtttacggtttaacccggtttttccgggggaaccggggtaaacggggaacccgaaacgggttcccgtacgggtaaccccggttcccggttcggggttaccgaacccggaccccgtaaacgggcccctacccgggttccccccgttaaccgggttccccttaaccccgg

SEQ ID NO: 305593 - DNA, 561 bp, Homo sapiens
  misc_feature: GZ8MTXP01BD0ZR.2.35.D02.1.454.CMB.2.raw
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggcgaacgcccccaaactcctcatttatgagtcactaagcggcccttagggggtcccctgactcgtcttctctggccctccaagtctggcaagaaccggcctccctgacccgtctcgtgggctccaagctggaggatggaggactgtaattatactgcagtctacgatntgcaggcngcagctaaagtcgttacgtttcgggcggacggaccaaagcgtaggacccgttcgttggggttccaacggccccgaaggcccttcggcccccgtttcggccttaacccg

SEQ ID NO: 305594 - DNA, 553 bp, Homo sapiens
  misc_feature: GZ8MTXP01BOINJ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccccggcgaaacgccccccaaactccctcatttatgaggtcactaagcggcccttagggggtccctgatcgcttctctggcctccaagtctgcaagaacggcctccctgaccctctctgggctaccagctggagatgagtctgtattatactgcagctcatatgacaggcagcaagctaaattcgtacgtttcgggcgggaacggaccaaaggcgtacggacccgttccgttggggttccaacggcccgaaggccctacgcccccgtcgttccgtaacccg

SEQ ID NO: 305595 - DNA, 644 bp, Homo sapiens
  misc_feature: GZ8MTXP01DL48K.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttataactatgtctctggtatacaacaacaccccgacgaacgacccccaaactcctcatttangacgtcactaagccggtccgttaggggtccctgactcgtcttctctcggccctccgaagtcgtggacaaacggaacccggtccctcccgtcgtacccgttcgtccgtcggggtcctacccgaaagtcctaggaagggtagtggaacgggtcttaggtaatttacttacgtgactagccttacgaattagtcgacgaggccagacaagactaaagttcgtttaccgtttcggggaacgggtaacgggaacctaaaggccgtacggtaacccggttccgttcgggggttaccaacggaaccccgtaagggtccctcccggttcccccgttcggttaacctccccg

SEQ ID NO: 305596 - DNA, 550 bp, Homo sapiens
  misc_feature: GZ8MTXP01DR0AA.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgacccccaaactcctacatttatgagtcactaagcggcccttaggggtccctgatcgcttctctggcctccaagtctggcaagaacggccctccctgacccgtctcgtgggctcccaagctggaggatgaggctagtattatactgcagtctcgaatatgcaggcagcagctaaatgttaacgtttcgggaacggaagggaccaaagcgtacgaccgttccgttggggttccaagccccgaaggcctacgccccctcgggttctaacccg

SEQ ID NO: 305597 - DNA, 730 bp, Homo sapiens
  misc_feature: GZ8MTXP01BLXPQ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaaacgccccccaaactcctacatttatgaggtcaactaagccggtcccgttaggggtcccctgactcgcttctcgtcggtcctccaagtctggcaaacgaaccggccctaccctcgacccgttctcgtgggcctacccgaagtcgtaggacggagtcggaagggtcttagtaatttaagtttaacctggactacgtaccttcgaactttaagttcggaccgaaagggtccagggactaaacggtacctaaaaggtttcggtttaaaccggtttttccgggggaaccggggttaaacgggggttaacccgaaaacgggttccgttaaccggggtaaccccgggtttcccgggttcgggggttaaccccgaacccgggtacccccgggaaaacggggttccccgttaccccgggttaccccccccgggtttccggggttccccgttaacccccg

SEQ ID NO: 305598 - DNA, 547 bp, Homo sapiens
  misc_feature: GZ8MTXP01ATQD1.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgcccccaaactcctcatttatgagtcactaagcggccttaggggtccctgactcgcttctctggcctccaagtctggcaagaaccggcctcccgtgacccgtctcgtcgggctccaagtctgagatgagctgtattatactgcagctcgatatgacaggcagcgagctaattgttacgtttcggcgggtacggaccgaagttcgtcgtaccgttccgttgggttcgaacggtcccgaacggtctccgttccccgtcgttccgtaaccg

SEQ ID NO: 305599 - DNA, 589 bp, Homo sapiens
  misc_feature: GZ8MTXP01ER3IE.2.35.D02.1.454.CMB.2.raw
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacgaccccggacgaaccgacccccaaactcctactatttangaggtacaacgtaacgccggtcccgttaggggtcccctgactcgtcttctctcggccctccaagtcgtggaccaaacgaaccggcccttcccgtcgacccgtctcgtcggggcctacgaagcgtagaggatggagtcgttgtaatttatactgcaagtctacattagtgacgaggcagcaagctaagtgttacgttcgggaacggtaacgggttaccaagttcgcgtacccgttcgttcgggttcaacgccgaagggcctccggccccttcggttaacctccg

SEQ ID NO: 305600 - DNA, 536 bp, Homo sapiens
  misc_feature: GZ8MTXP01AJSI8.2.35.D02.1.454.CMB.2.raw
  modified_base (431)..(431): a, c, t, g, unknown or other
  misc_feature (431)..(431): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaacgccccccaaaactcctcatttatgagtcactaagcggcccttagggggtccctgatcgcttctctggcctccaagtctggcaagaacggcctccctgaccgtctctgggctccaagctgacggatgaggctgattatactgcagctacntatgcaggcagcagctaatgtacttttcgggcgtagggaccaagccgtgaaccgttcgttgggttcgaacgccccgaaagggctcgcccctcgggttcctaaccg

SEQ ID NO: 305601 - DNA, 581 bp, Homo sapiens
  misc_feature: GZ8MTXP01BF63O.2.35.D02.1.454.CMB.2.raw
  modified_base (421)..(421): a, c, t, g, unknown or other
  misc_feature (421)..(421): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaaacgccccccaaactccctcatttatgagtcactaagcgcccttaggggtccctgatcgcttctctggcctccaagtctggcaagaaccgcctcctgacctcgggtctgggctcagctgagatgaggctagtattattacgngcagtctagtatagtcgacgaggcagacgagtactaagttcgttacggttcgggaacgggaacggaaccgacgttccgtacggtacccggttcggttcgggttaccgaaccggacccgtaacggtcccgttcccgttcccccgttcggttcccgtaaccg

SEQ ID NO: 305602 - DNA, 566 bp, Homo sapiens
  misc_feature: GZ8MTXP01BT5T4.2.35.D02.1.454.CMB.2.raw
  modified_base (446)..(446): a, c, t, g, unknown or other
  misc_feature (446)..(446): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaaacgccccccaaactcctactatttatgaggtcactaagcggtcccgttagggggtccctggatcgctttctctggccctccaagtctggcaaagaaccggccctccctgacccgtctcgtcggggcctccaagctgaggatgaggctgatttattactgcagcctanattatgcaggcagcagctaagtgttacgtttcgggaacgggtaagggaccaaaggcgtacggaccgttccgttgggttccaacgcccgaaggcctcggcccccgtcggttccgtaacccg

SEQ ID NO: 305603 - DNA, 536 bp, Homo sapiens
  misc_feature: GZ8MTXP01DK73I.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgccgtccgggtctcctggacagtcagtcaccatctcctgcactggagcagcagtgacgttggcgttataactatgtctcctggtatcaacaacaccccggcgaagcccccaaactcctcatttatgaggtcactaagcggcccttagggggtccctgactcgcttctctggcctccaagtctggcaagaaccggctccctgaccgtctctgggctccaagctgaggatgaggctgtattattactagccagtcctcgtaatatagcaggcagcagctaagtgtacgttttggcggtaaggccaagcgtgaccgttcgttggggttcaacgtccgaaggcctcgccccgtggttctaaccg

SEQ ID NO: 305604 - DNA, 660 bp, Homo sapiens
  misc_feature: GZ8MTXP01BWHTM.2.35.D02.1.454.CMB.2.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcacgtggagcagcagtgacgttggcgttataactntgtctctgtatcaacacacccgcgaacgccccaaatcctacatttangacgtacaacgtaacgcggtccgttagggtccctgactcgtcttctcgtcggccctaccgtaagtcgtacggaccaaacggaacccggtccctacccgtacggtaccccgttcgtccggtcggggtaccttacccgaaagtccgtaggacggaacgttggaacgggtcttaggtaactttattaccgtagcaacgtcctacgaattacgcgacgaggactagacgtaacgtacgtaacgttcgtttacggttcgggaacggtaacggaaccgtacgttccgtaccggtacccgttccggttcggttaccgaaccggtacccggtaacggtcccgtcccggttaccccgttcggttcccgtaaccg

SEQ ID NO: 305605 - DNA, 622 bp, Homo sapiens
  misc_feature: GZ8MTXP01EOP5R.2.35.D02.1.454.CMB.2.raw
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaagccccccaaactccctcatttatgaggtcaactaaacgcggacccctttagggggtcccctgatcgcttctctggcctccaagtctggcaagaacggcctccctgaccgtctctggggctccaagctgaggatggaggtctgattatttacgngctagctcgtatagtgacgaaggcagacaacgtactaagttcggtttaaccgtttcggggaacggggtaacgggaaccgtaacggttccgtacgggtaaccccggttccggttcggggttaccgaaccggaccccgtaaacgggtcccgtccccggttacccccggttccggttaacccgtaacccg

SEQ ID NO: 305606 - DNA, 593 bp, Homo sapiens
  misc_feature: GZ8MTXP01DRUVR.2.35.D02.1.454.CMB.2.raw
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggacgttaataactatgtctcctggtatcaacaaccaccccggacgaaacgcccccaaactcctacatttangagtcactaagcggcccgtttaggggtccctgactcgtcttctcgtcggtccctccaaagtctcggcaacggaaaccggtccctccctcgacccgtctcgtcgggctcccaagctggagatgnggactgtaattattacngcagctcgtaatatcganacgggnacgnagtctaaattgttacgtttcggggaacggtacgggacctaaaggcgtacggtaacccgttcgttcgggttaccaacgtacccgaacggtctcccggccccgttcgggttccttaacccg

SEQ ID NO: 305607 - DNA, 778 bp, Homo sapiens
  misc_feature: GZ8MTXP01DAGCJ.2.35.D02.1.454.CMB.2.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcacgtggaggcagcagtgacgttggcgttataactntgtctctgtatcaacaacaccccggacgaacgacccccaaactcctactatttanagtacggtcaacgtaacgcggtacccgttacgggggtccctagactcgtcttctcgtcggccctaccgaagttctacgggacctaaacgggaaaccggtccctaccccgtaggtaccccggttcctccggttcggggccttacccgaaacgtcgttaggaaggagtaggaacgggtccttagtaagtttaacttaacgtcggtacctaggacccttacgtaaactttaacgggtacggacggaacggaccgaacggtacgtaaacggtaccgttaaacggtttaccggttttaaccgggttttaccgggggaaccggggtaaaccggggttaaacccggtaaaccggttacccggttaacccgggttaccccgggttacccgggttacggggttacccgtaacccgggtaaccccggtaaccgggtccccggttaccccgggttaccccccggttccggttaaccccgtaaccg

SEQ ID NO: 305608 - DNA, 571 bp, Homo sapiens
  misc_feature: GZ8MTXP01EVIWR.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggacgaaacgccccccaaaactcctcatttatgagtcactaagcggcccttaggggtccctgatcgcttctctggcctccaagtctggcaagaacggccctcctgacccgtctcgtgggctccaagctgaggatgagctgtattattactgcagctacgattatgcaggcagcagctaaagttgttacgttttcgggcggtaacgggaccaaagccgtacggaacccgttccgttcgggttaccaacggccccaaacgggtccctccggttccccccgtcgggttaacccgtaacccg

SEQ ID NO: 305609 - DNA, 644 bp, Homo sapiens
  misc_feature: GZ8MTXP01CTCJH.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatacaaacaaccaccccggcgaaacgaccccccaaactccctactatttactgacggtacaactaacgccggtaccccgttacgggggtccctggacttcgtctttcctcgtcggtccctaccaagtcctggacaaacggaacccggccctccctacggtacccgtctcgtcggggctacccgaagtctaggaggtactaggacggtcttagtatttaattactgtacagtctacatagtgacaggcagacagactaaagttcgttaaaccgtttcgggaacgggtaacggaccgtaaacggccgttacggacccggttaccggttcgggttaccgaaccggacccgaacggtccctacccggttccccctcgggttccctaaccg

SEQ ID NO: 305610 - DNA, 556 bp, Homo sapiens
  misc_feature: GZ8MTXP01A61OM.2.35.D02.1.454.CMB.2.raw
  modified_base (300)..(300): a, c, t, g, unknown or other
  misc_feature (300)..(300): n is a, c, g, or t
  modified_base (429)..(429): a, c, t, g, unknown or other
  misc_feature (429)..(429): n is a, c, g, or t
  modified_base (503)..(503): a, c, t, g, unknown or other
  misc_feature (503)..(503): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccgcgaacgcccccaaactcctcatttangagtcactaagcggccctttagggggtcccctgactcgcttctctggcctccaagtctggcaaagaaccggcctccctgacccgtctcgtcgggctccaagctggacggatggagtctgtattattacngcagtctcgattatgacaggcaagcagctaaatgtacgtttggcggaagggaccaagccgtagaccccgttcgngggttccaaggtccccgaagggtccctcggcccccctcgggttaaccccgtcg

SEQ ID NO: 305611 - DNA, 567 bp, Homo sapiens
  misc_feature: GZ8MTXP01CS0SJ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaaacgcccccaaactcctcatttatgaggtcactaagcgcccttagggtccctgactcgcttctctcggccctccaagtctggcaacggaaccggccctcccgtcgacccgttctcgtcgggctccgaagtcgtggaggagtggaaggtctgtattattactgcagtctacgatatgcgaggcagcagctaatcgttacgtttcgggcggtaaggacctaacgcgtacggaccgttcgttgggttaccaacggacccgaacggccgtccggcccctcggttccgtaaccg

SEQ ID NO: 305612 - DNA, 524 bp, Homo sapiens
  misc_feature: GZ8MTXP01ARD7G.2.35.D02.1.454.CMB.2.raw
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaaacgccccccaaactcctcatttatgaggtcactaagcggccccttagggggtccctgatcgcttctctggcctccagtctggcagacgctccngaccgtctctgggctccaagctgaggntgagctgtattatactgcagctcgatactgcaggcagcagcaatgtactttcgggcgtagggacaagctggaccgttccgttgggttccaaggccccaaggcctcgccccctggttaacctcccg

SEQ ID NO: 305613 - DNA, 608 bp, Homo sapiens
  misc_feature: GZ8MTXP01DPSJH.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaaacgcccccaaactccctcatttangaggtcactaagcggcccttagggggtccctgatcgtcttctctcggccctccaagtctggcaacgaaccggcctccctcgacccgtctcgtgggctccaagctggaggatgaggctagtatttattacagcagtctacgtattatcgacgagggccaggccaaggctaaagttcggttacgttttccgggaacgggtaacgggaaccgaaacgccgttacggacccggttccgttcggggttaccgaaccggaccccgaagggtcccctccggttcccccgttcgggttccctttaaccccgg

SEQ ID NO: 305614 - DNA, 575 bp, Homo sapiens
  misc_feature: GZ8MTXP01C7N7D.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaggcagcagtgacgttggcggttataactatgtctctggtatcaacaacaccccggcgaaacgccccccaaaactccctactatttatgaggtcaactaagccggacccttagggggtcccctgactcgcttctctcggccctccaagtctggcaacgaacggccctcccgtgacccgtctcgtcgggcctaccaagctggaggatggaaggctgtattagttactgtcagctacatatcgacgaggcagcaacgactaaagttcgtacgttttcgggcgggtaacgggaccaaaggcgtcggaccgttccgttcggttcgaacgcccgaaggccgtcgcccctcggttctaaccg

SEQ ID NO: 305615 - DNA, 882 bp, Homo sapiens
  misc_feature: GZ8MTXP01C132E.2.35.D02.1.454.CMB.2.raw
  modified_base (243)..(243): a, c, t, g, unknown or other
  misc_feature (243)..(243): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctctgcactggagcagcagtgacgttgcgttataactntgtctcctggtatcaacaacaccccggcgaaacgaccccccaaaactcctactaatttagtgaacggttcaacgttaaacggccggtacccccgttttaacggggggttccccctaggaacttccggtctttccgtccgttcgggtacccccttcccgaaaaggttcccgttaggggaccctaaaacgggaaaccccggggtccccttcccccgttacgggaaacccccggttttcccgtaccggtttaccggggggcccctttacccccgaaaacgggtccccgtttaaggggaaaccggggaacgtttacgggaaagggggtccctttaacggggttaaagtttttaaactttaaaccgttcgggtacaaacgggtcctttaaccgaaacgttttaaagttcggacccgtaaagggtcccaagggtacccaaagggtaccttaaaagttcggtttaaacccggttttttaccgggggaaccgggtaaacgggggttaaaccccgtaaaacgggttcccgttaacggggtaaacccccgtttcccgggtttcgggggttaacccgtaacggtaacccccggaaagggttccccgttacccggttcccccccgtttaacgggttccccgtttaaccccg

SEQ ID NO: 305616 - DNA, 551 bp, Homo sapiens
  misc_feature: GZ8MTXP01BWT4F.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaaacgccccccaaactcctcatttatgagtcactaagcggtcccttaggggtcccctgactcgcttctctggccctccaagtctgggcaaggaaccggcctcccgtgaccgtctcgtggggctccaagctgaggatgaggctgatttattactgcagctcgatagtgcgagcagcagctaagtgtacgttttcgggcggtaagggaccgaaagcgtacgaccgttcgttcgggttcaacgcccgaaggcctcgccccctcggttcctaacccg

SEQ ID NO: 305617 - DNA, 552 bp, Homo sapiens
  misc_feature: GZ8MTXP01DWC30.2.35.D02.1.454.CMB.2.raw
  modified_base (438)..(438): a, c, t, g, unknown or other
  misc_feature (438)..(438): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgccccccaaactcctcatttatgagtcactaagcggcccttaggggtccctgatcgcttctctcggccctccaagtctggccaacgaaccggcctcccgtgacccgttctcgtgggcctaccaagtctaggaggatggaggtctagtatttagttacngcagtctacgattatgcgaggcagcagctaaagttgtacgtttcgggcggagggaccaagcgtcggaccgttcgttgggttcaacggccgaaggcctcggccccgtcggctccg

SEQ ID NO: 305618 - DNA, 567 bp, Homo sapiens
  misc_feature: GZ8MTXP01D05MX.2.35.D02.1.454.CMB.2.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggagcagcagtgacgttggcgttataactntgtctcctggtatcaaacaacaccccggcgaaacgcccccaaactcctcatttatgaggtcaactaagcggcccgttaggggtcccctgactcgcttctcgtcggtccctccaagtctggcaacgaaaccggcctccctgacccgtctcgtcggggctacccaagctaggaggatgagggtctagtatttatacgtgcagtctacgatatgcgaggcagcagctaaatcgttacgtttgggcggtagggaccaaagcgtagtacccgttcgttgggttccgaacgcccgaaggcctcggttcccctcggttctaacccg

SEQ ID NO: 305619 - DNA, 560 bp, Homo sapiens
  misc_feature: GZ8MTXP01DUK9V.2.35.D02.1.454.CMB.2.raw
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttaataactatgtctctggtatcaacaacaccccggcgaaacgcccccaaaactcctacatttatgaggtcactaaagcggcccttagggggtccctgatcgcttctctggcctccaagtctggcaagaacggcctccctgaccgtctcngggctaccaagctgaggatgaggctgattattacngacagtctacatatgacgagcagacagactaagttcggttacgtttcggggaacggaacgggaaccaagcgtacggtaccgttcggttcgggttaccgaacgacccgaacggccgtcccgccccgtcggttcctccg

SEQ ID NO: 305620 - DNA, 604 bp, Homo sapiens
  misc_feature: GZ8MTXP01AS3WK.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctcatttatgaggtcactaagcggtcccgttaggggtccctgactcgtcttctctcggcctccaagtctggcaacgaaccggcctccctgacccgtctcgtcgggctccgaagtcgtggacggatggaggtctagtattacttacgtgacagtctacgattagtgaccgaggccagccgaagctaaagttcgttaacgttttcgggaacgggtaacgggacctaaacggttccgtacggtaacccgttccggttcgggttaccgaacggcccgaacggccgtcccggcccccgttaacggttccctaacccg

SEQ ID NO: 305621 - DNA, 599 bp, Homo sapiens
  misc_feature: GZ8MTXP01EOK4X.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggacgaacgacccccaaactcctctatttatgaggtcactaagcggcccgttagggggtcccctgatcgtcttctctcggccctccaagtctggacaaacgaaccggccctccctgacccgttctcgtcggggctccaagctaggaggatggaggtctagtattattctagcagcttcgaattatgacgaggcagcaagactaaagttcggtttacgttttcgggaacgggtaacggttacccgaaagcgtacggtacccgttccgttcggggttacaacggacccgaacggtccgtcccgttccccgttccggttccttaacccg

SEQ ID NO: 305622 - DNA, 724 bp, Homo sapiens
  misc_feature: GZ8MTXP01BOCRJ.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatacaacaaccaccccggacgaaacgcccccaaactcctactatttatgacgtcaactaacggcggtacccgttaggggtccctgactcgtctttctcgtcggccctaccgtaagtcgtggaccaaacggaacccggtcccttcccgtacgtacccgttcctcgtcggggccttaccgaagtccgtaggaacggagtggacggtcttaggttaactttacgttaacgtcgactaacgtcttacgtaattacgtcgacgaacggaccacgaccgaagtaccgtaaagtttcggttttaaaccggtttccgggggaacgggtaaacgggttaacccgtaaacgggttcccggttaccgggtaacccgggtttcccgggttcggggttacccgtaaaccgggtaccccgtaaacggggtccccggtttaccccgggacccccccgtttcggggttaaccccttaacccg

SEQ ID NO: 305623 - DNA, 539 bp, Homo sapiens
  misc_feature: GZ8MTXP01CXXGD.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttaataactatgtctctggtatcaacaacaccccgcgaacgcccccaaactcctcatttatgagtcactaagcggcccttaggggtccctgactcgcttctctcggccctccaagtctggcaacgaacgccctccctgacccgtctctgggctcaagctgagatgaggctgattatactgcagctcgatagtgcaggccagcaaagctaaatgttacttttcgggcggtagggaccaaggctaggacccgttccgttgggttcaacgcccgaaggcctccgccccgtcggttctaaccg

SEQ ID NO: 305624 - DNA, 713 bp, Homo sapiens
  misc_feature: GZ8MTXP01D5FT2.2.35.D02.1.454.CMB.2.raw
  modified_base (248)..(248): a, c, t, g, unknown or other
  misc_feature (248)..(248): n is a, c, g, or t
  modified_base (556)..(556): a, c, t, g, unknown or other
  misc_feature (556)..(556): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaaacaacaccccggacgaaacgacccccaaactcctactaatttactagtaacggtacaacttaaacggccgggtaccccgtttaacgggggtccccttaggtacttccggtcctttcctcgtcgggtccccttacccgtaaagttccgtgggacccgaaacgggaaacccgggtccccttccccgtacggtaccccgggttccttccgtcgggggtccttacccgaaagtccgttaggaagggattggaagggtctaggtaatttaattacgtgactacgtctacgtaattagngacgacggcacgtacaacgtactaagttacgtttaccggtttcggggaacgggtaacggaaccgaacggttccgtaccggtacccggttccggttcgggttaccgaaccggacccgaacggtcccgtcccggttcccccgttccggttccctaaccg

SEQ ID NO: 305625 - DNA, 527 bp, Homo sapiens
  misc_feature: GZ8MTXP01AIIMW.2.35.D02.1.454.CMB.2.raw
  modified_base (245)..(245): a, c, t, g, unknown or other
  misc_feature (245)..(245): n is a, c, g, or t
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttanaactatgtctcctggtatcaacaacaccccggcgaacgccccccaaactcctcatttatgaggtcactagcgcccttaggggtccctgatcgcttctctggcctccagtctggcaagaacggcctccctgaccgtcncgtgggctccaagctgaggatgaggctagtattattactgctagntcgatangcaggcagctagcaatgttaacttttcgggcggagggaccaaaggctggaccgttcgngggttcaacgccaaggcctcgcccctcggctaacc

SEQ ID NO: 305626 - DNA, 644 bp, Homo sapiens
  misc_feature: GZ8MTXP01EV3IF.2.35.D02.1.454.CMB.2.raw
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgcccccaaactcctcatttangagtcactaagccggtacccgttaggggtcccctgtactcgtcttctcgtcggccctaccaagtctggaccaaacggaaccggtccctcccgtgtacccgtctccgtcggggctccgaagctggaggtagtggagtctagtattactactcgcagtctactattagtcgacgagggaccagaccgaagtacgtaaagttcggtttaaccggtttcgggggaacgggtaaacgggttaaccgtaaacggttccgtacgggtaaccccggttccggttcggggttaccaaccgggaccccgtaacggtcccgtcccggttacccccgttcgggttcccttccccgg

SEQ ID NO: 305627 - DNA, 660 bp, Homo sapiens
  misc_feature: GZ8MTXP01AOFQI.2.35.D02.1.454.CMB.2.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntctcctgcactggagcagcagtgacgttggcgttataactntgtctctgtatacaacaaccacccggacgaacgacccccaaactcctactatttatgaacggtccaactaaacggccggtacccgttacgggggtccctgtacgtcgtctttctcgtcggccctaccaagtctggacaaacgaaccgccctcccgtcgtacccgtcctcgtcgggtcctaccgaacgcgtaggaggtacgtggaggtacttaggtaatttacgttaaccgttgactaagtcctacgtaattagtacgacgaggacgacggacaacgaccgttaagttacggtttaccggtttacgggaacgggtaacgggaccaaaggccgtacggtacccgttccggttcgggttaccgaacggaccccgtaacggcccgtcccggttcccccgtcggttaaccctccccg

SEQ ID NO: 305628 - DNA, 561 bp, Homo sapiens
  misc_feature: GZ8MTXP01DOYQZ.2.35.D02.1.454.CMB.2.raw
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgccccccaaactcctcatttatgaggtcactaagcggcccttagggggtcccctgatcgcttctctggccctccaaagtctggcaagaaccggcctccctgacccgtctctggggctccaagctgaggatgaggctgattatactgcagctacatatgcaggcagcagctaatgtacttttcgggcggtacgggaccaaacgcgtacggacccgttcccgttggggttccaaggaccccaaagggtcccgtaccggttcccccgtcgggttcccgtaacccg

SEQ ID NO: 305629 - DNA, 566 bp, Homo sapiens
  misc_feature: GZ8MTXP01D2SCZ.2.35.D02.1.454.CMB.2.raw
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgcccccaaactcctcatttangagtcactaagcggtcccttagggggtccctgactcgcttctctcggcctccaagtctggcaacgaaccggcctcccgtgacccgtctcgtgggctccgaagtctaggaggatggaagctgtatttatacgtgcagtctctatagtcgacaggcaggcagctaatgttacgtttcgggaacggtacggaccaagttcgtacggtacccgttcgttcgggttacaacggtacccgaaggtccgtccgccccgttcggttcctaacccg

SEQ ID NO: 305630 - DNA, 592 bp, Homo sapiens
  misc_feature: GZ8MTXP01AZGHN.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgccccccaaactcctcatttatgaggtcactaacgcggtcccttagggggtcccctgatcgcttctctggccctccaagtctgggcaaagaaccggccctaccctgacccgtctccgtggggcctccaagctggaggatgaggctgtatttattactgacagcttacattaatgacgagggcaggccaggactaaatcggttaacgttttcgggaacgggtaacgggaccgtaaacgcgtacggacccgttccgttgggttcgaaccggacccgtaacgggccgtcccggcccccgttcgggttccctaaccg

SEQ ID NO: 305631 - DNA, 593 bp, Homo sapiens
  misc_feature: GZ8MTXP01D4B3T.2.35.D02.1.454.CMB.2.raw
  modified_base (432)..(432): a, c, t, g, unknown or other
  misc_feature (432)..(432): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttaataactatgtctctggtatcaaacaacaccccggacgaaacgcccccaaaactcctactatttatgagtcactaaagcggccttaggggtccctgatcgcttctctggcctcaagtctggcaaaggaaccgcctcctgacccgttctcgtcgggcttaccaagctgaggatgaggactagtattattacgngacacgtctagtatagtcgacgagacagacgaagactaagttacgttacggtttcgggaacgggtacgggaacgtaacgttcgtacggtaccgttcggttcggttaccgaaccggtacccgaacggtccgtcccggttaccccgttccggttccgtaaccg

SEQ ID NO: 305632 - DNA, 607 bp, Homo sapiens
  misc_feature: GZ8MTXP01EFQZM.2.35.D02.1.454.CMB.2.raw
  modified_base (306)..(306): a, c, t, g, unknown or other
  misc_feature (306)..(306): n is a, c, g, or t
  modified_base (440)..(440): a, c, t, g, unknown or other
  misc_feature (440)..(440): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggacgaaacgacccccaaactcctactatttangagtcactaagcggccttaggggccctgatcgtcttctcgtggtccctaccgaagtcgtggcaaacggaaccggtccctccctgacccgttctcgtgggctacaagctaggagatgaggctagtattagttacngacagtctagtagtagtgacgacggcagacgaagtacgtaagttacggtttaccggttcgggaacgggtaacgggaaccgaacggttccgtacggtaaccgttagttacggttcgggtaaccgacggaacccgacggtcccgttacccggtcccccgttcggtcccg

SEQ ID NO: 305633 - DNA, 647 bp, Homo sapiens
  misc_feature: GZ8MTXP01ECLLO.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaaacaacaccccggacgaacgacccccaaactcctactatttatgaggtcacgtaagccggtacccttagggggtccctgactcgtcttctcgtcggcctccaagtctggcaaacgaccgcctccctgacccgtctcgtcgggctaccaagctagaggtatggaagtctagtacttatactgacagtcctagtaattagtcgaccgaagggcaacggcaaacggtctaaagtttcggtttaacgtttccgggggaacgggtaacgggaccgtaaagggttccgtacgggtaaccccggttccggttcggggttaccgaacccggggtacccgaaacgggttcccgtaccccgggccccccctttcggggttcccctttaaccccgg

SEQ ID NO: 305634 - DNA, 685 bp, Homo sapiens
  misc_feature: GZ8MTXP01EC7PQ.2.35.D02.1.454.CMB.2.raw
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggagcagcagtgacgttggcgttaataactntgtctctgtatcaacaacgacccgacgaacgaccccaaactcctactatttangagtcacgtaacgcggtaccgttacggggtccctgactcgtcttctcgtcggccctacgtaagtcgtacggaccgaaacggaacccgtcccgttccgtacggtacccgttccgtcggtcggggtacctaccgaacgtcgtaggtaggagttggaacgggtacttagttaactttacgttaacgtcgactacgtaccttactaagttacgtcgacgacggcaacgacgtaacgtacgttaaacgttcggtttaaccggtttcggggaaaccggttaaggaaacccgtaaacggttccgtaccggtacccggttaccggttcgggaccgtaaccggtacccgtaacggtcccgttcccggttccccgttaacggttcccttaacccg

SEQ ID NO: 305635 - DNA, 550 bp, Homo sapiens
  misc_feature: GZ8MTXP01DLKMZ.2.35.D02.1.454.CMB.2.raw
  modified_base (422)..(422): a, c, t, g, unknown or other
  misc_feature (422)..(422): n is a, c, g, or t
tcagacgctcgacacacgaccggtgctcgatttagcacacgatagttgggtttgggggtctcaggaggcagcgctctcaggacgtcaccaccatggcctgggctctgctcttcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacacccccggcgaaacgccccccaaaactccctcatttatgagtcactaagcggccctagggtccctgatcgcttctctggcctccaagtctggcaacgaacgcctccctgaccgtctctgggctccaagctgaggatggagctgattatactgnagtctcgatatgcaggcagcagctaattgttactttcgggaacggagggaccaagccgtgtacccggttaccgttgggttaccaacggaccccgtaaggcctccgcccccgttcggttccgtaacccg

SEQ ID NO: 305636 - DNA, 556 bp, Homo sapiens
  misc_feature: GZ8MTXP01B2HH9.2.35.D02.1.454.CMB.2.raw
  modified_base (405)..(405): a, c, t, g, unknown or other
  misc_feature (405)..(405): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggacgttataactatgtctcctggtatcaacaacaccccggcgaaacgaccccccaaaactccctacatttatgagtcactaagcggccttaggggtccctgatcgcttctctgcctcaagtctgcaagaaccggccctcctgacccgtctcgtgggctcaagctggagntgaggctgattatactgcagctcgaattangacgagcagacgaagtactaagttacggttacggttcgggaacggtaacggaaccgaagcgtacgtaccgttcgttcgggacaacgacccgaacggccgtccgccccgtcgttcctaaccg

SEQ ID NO: 305637 - DNA, 539 bp, Homo sapiens
  misc_feature: GZ8MTXP01AO588.2.35.D02.1.454.CMB.2.raw
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggcgttataactntgtctctgtatcaacaacacccgacaacgcccccaaactcctcatttangagtcactaagcggtcccgttagggtccctgactcgcttctcgtggccctcagtcgtgcaagaccggcctaccctgacccgtctcgtgggctaccagctggaggatggagctgtatttatactgacagctanatagtgacgaggcagcagctaagtcgttacgttcgggaacggtacggacagcgtcgaccgttcgttcgggcaacgcccgaacggtcctccgttccccgtcgttcctccg

SEQ ID NO: 305638 - DNA, 562 bp, Homo sapiens
  misc_feature: GZ8MTXP01B7IAA.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccggcgaaacgccccccaaaactcctactatttatgacggtcactaaagcggtcccttaggggtccctgatcgctttctctcggcctccaagtctggcaacgaaccgcctccctgacccgtctcgtgggctcaagctgagatgaggtctgtattatactgcagctcattatgacaggcaggcagctaaagtcgttacgttttcgggaacgggtaagggaccgaaacgcgtacgtaccggttccgttcgggttccaacggcccgaacggcctcgccccgtcggttctaacccg

SEQ ID NO: 305639 - DNA, 597 bp, Homo sapiens
  misc_feature: GZ8MTXP01EL4WZ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgccgtccgggtctcctggacagtcagtcaccatctcctgcactggagcagcagtgacgttggcgttataactatgtctctggtatcaacaacaccccggcgaacgcccccaaactcctcatttatggacgtcactaacgccggtacccgttacgggggtccctgacttcgtcctttctcgtcggcccttaccaagttctcgggaccaaacggaaccgtcccctcccgtcgacccgttcctcgtcggggacctacccgaacgtcgtagacggagtgagggtctagtattacttacgtcgctaagctacaagtagtgacgaggcagacagtactattgttacgtttcgggaacggtaggactagcgtacgtacgttcgttcggttacaacgccgtaaggccgtccgacccgtcggttctaaccg

SEQ ID NO: 305640 - DNA, 586 bp, Homo sapiens
  misc_feature: GZ8MTXP01A8FLY.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcactggaggcagcagtgacgttggcgttataactntgtctcctggtatcaaacaacacccccggacgaaacgccccccaaactcctcatttatgaggtcactaagcggcccgttagggggtccctgactcgtcttctctggcctccaagtctggcaagaaccggcctccctgaccgttctcgtgggcctcgaacgctgaggatcgagctagtattattactgcagctcgatatgcaaggcagcagactaatcgttacgttttcgggaacggtaacggggacccaaaggccgttcggaacccggttccgttcggggttccaacggccccgtaaacgggccctccggccccccgttcgggttccctaaccccg

SEQ ID NO: 305641 - DNA, 579 bp, Homo sapiens
  misc_feature: GZ8MTXP01BCYCJ.2.35.D02.1.454.CMB.2.raw
  modified_base (408)..(408): a, c, t, g, unknown or other
  misc_feature (408)..(408): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgcccccaaactcctcatttatgaggtcactaagcggccgttaggggtccctgactcgcttctctggccctccaagtctggcaacgaaccggtccctccctgacccgtctcgtcgggctccagctggagntggagtctgtaattatacgtgcagtctctatatgacgaggcagcagctaagtcggttacgtttcgggaacggtaggaccgaagccgtacggtaccggttcccggttggggttacccaacgggccccgtaacgggcccgtcccgttcccccgtcgggttcccgttaaccccg

SEQ ID NO: 305642 - DNA, 569 bp, Homo sapiens
  misc_feature: GZ8MTXP01BW8NX.2.35.D02.1.454.CMB.2.raw
  modified_base (248)..(248): a, c, t, g, unknown or other
  misc_feature (248)..(248): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (530)..(530): a, c, t, g, unknown or other
  misc_feature (530)..(530): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacacccggcgaaacgcccccaaactcctctatttatgaggtcaactaaggccggtcccgttagggggtcccctgactcgtcttctctggccctccagtctggcaaacgaaccgcctcccgtgacccgtctcgtcggggctccgaagcgtggacggatgaggctagtaatttattacngcagtcctnattagtgcgaagcagcagactaagtcgttacgtttcgggaacggacgggacaagcgtcgaccggttcgttcgggttacncgacccgaaggtcctccgccccgttcggttcctaacccg

SEQ ID NO: 305643 - DNA, 607 bp, Homo sapiens
  misc_feature: GZ8MTXP01CAZTS.2.35.D02.1.454.CMB.2.raw
  modified_base (247)..(247): a, c, t, g, unknown or other
  misc_feature (247)..(247): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttataactntgtctctgtatcaacaacacccgacgaacgaccccaaactcctactatttatgacgtacactaagccggtacccgttaggggtccctgactcgtcttctctggccctcaagtctggacaacgaaccgcctccctgacccgtctcgtcgggctccaagtcgtagagatgaggtactgtaattagttacngacagtctacgtatgtcgacaggccagcaacgctaaagttgtttaaccggtttcgggaacggtaacgggaccgtaaacggccgttacggtacccggttccggttcgggttaccgaaccggtaaccccgtaaggtccccgtcccggccccccgttcgggttcccttaaccccg

SEQ ID NO: 305644 - DNA, 665 bp, Homo sapiens
  misc_feature: GZ8MTXP01AMTBU.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtgacgtgcgttatactatgtctctggtatacaacaaccaccccggacgaaccgacccccaaactcctacatttangtaggtcaactaacgccggtacccgttagggggtcccctgactccgtcttctcgtcggcccttaccaagtcgtaggccaaacgggaacccggtcccttacccgtcggtaccccgttctccgtcggggaccttacccgaagcctggaaggacgtaggaggtctaggttaattacgttaaccgttgacgtagtactactagtagtcggacgaacgggccaggacccgaagtaccgtaaaggtttcgttaccgttttcggggaacggtaacgggaaccaacggttcgtacggtaacccgttccgttcgggttaccgaaccgacccgtaacggcctccggcccccgtcggttaaccgttccccg

SEQ ID NO: 305645 - DNA, 535 bp, Homo sapiens
  misc_feature: GZ8MTXP01ESFS1.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttgcgttanaactntgtctctggtatcaacaacaccccgganaacccgncncnataactccctactattactagtacggtctacgtaacgcgtaccgttacggtcctcatcgctctctgctccaagtactcgcacgaacggcctccctgaccgtctactcggctccgaagctgaggatgtaggtactgagttattactgacagctcatatgcaggcagaactacgttacgtaacgttacggtacgtttacgggacggacgggaccgaacgtcgtcgaccgtccgttacggtcgaacgtcccg

SEQ ID NO: 305646 - DNA, 533 bp, Homo sapiens
  misc_feature: GZ8MTXP01AYKW8.2.35.D02.1.454.CMB.2.raw
  modified_base (378)..(378): a, c, t, g, unknown or other
  misc_feature (378)..(378): n is a, c, g, or t
  modified_base (514)..(514): a, c, t, g, unknown or other
  misc_feature (514)..(514): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgccccccaaactcctcatttatgaggtcactaagcggcccttagggggtccctgactcgcttctctggccctccaagtctggcaagaaccggcctcccngacccgtctcgtcgggctccaagctgaggatgaggctgtattattacgtgcagtctcgatatgcgaggcagcagctaatgtactttcgggcggtaggacaagcgtgacccgttcgttcggttcgaagcccgaagcncgcccctcggttccgtccg

SEQ ID NO: 305647 - DNA, 572 bp, Homo sapiens
  misc_feature: GZ8MTXP01BN4XZ.2.35.D02.1.454.CMB.2.raw
  modified_base (428)..(428): a, c, t, g, unknown or other
  misc_feature (428)..(428): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttatgaggtcactaagcggtcccgttaggggtccctgatcgcttctctggcctcagtctggcaagaccgcctccctgacccgtctcgtcgggctacccgaagctggaggctggaggtctgtatttattacngcagtctacgattagtgcgagcaagccagactaagttcgttacgtttcgggaacggtacgggacagcgtacggaccgttccgttgggttccaaccggtacccgaacggtcccgtaccggttcccccgtcgggttccctaacccg

SEQ ID NO: 305648 - DNA, 557 bp, Homo sapiens
  misc_feature: GZ8MTXP01EHR76.2.35.D02.1.454.CMB.2.raw
  modified_base (523)..(523): a, c, t, g, unknown or other
  misc_feature (523)..(523): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggacgaaacgccccccaaactcctcatttatgaggtcactaagcggtccgttaggggtccctgactcgcttctctcggcctccaagtctggcaagaaccggccctccctgacccgtctcgtgggctccaagctgaggatggaggtctgtatttatactgcagctacgattagtgacgaggcagcagctaagttcgttacgtttgggaacggtaagggaccaaggcgtcggaccgttcgttcggggttacncgcccgaaggcctcggcccctcggttctaacccg

SEQ ID NO: 305649 - DNA, 563 bp, Homo sapiens
  misc_feature: GZ8MTXP01DBTQ1.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttaataactatgtctcctggtatcaacaacaccccggcgaaacgccccccaaaactccctcatttaatgaggtcactaagtcggcccttaggggtccctgatcgcttctctcggcctccaagtctggcaacgaacgcctccctgacccgtctctggggctcaagctgaggatgaggctgtattatactgcagctcgatatgcgaggcagcagctaaagttgtacgttttcgggaacggtaacgggaccaaacgcgtacggtacccgttccgttcgggttacaacggcccgaacggtcctccgccccgttcggttccgtaacccg

SEQ ID NO: 305650 - DNA, 590 bp, Homo sapiens
  misc_feature: GZ8MTXP01BW7XC.2.35.D02.1.454.CMB.2.raw
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctactatttaatgaggtcaactaagccggtacccgtttacggggtcccctgactcgcttctctcggccctccaagtctcggcaaacggaaccggccctcccgtcgacccgttctcgtcggggcctccaagctgaggatggaggctagtatttattacgtgcagtctacgattagtcgacgaggcgagcaagactaagttgttaccgtttcggggaacggtaacggacccgaagccgtacggaccgttcgttcgggttccaacgacccgaacgtccgtccgcccctccggttctaacccg

SEQ ID NO: 305651 - DNA, 574 bp, Homo sapiens
  misc_feature: GZ8MTXP01CVAEH.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccgcgaacgaccccaaactcctcatttatgacggtcactaagcggcccttaggggtccctgatcgtcttctctggccctccaagtctggcaacgaaccgcctccctgacccgtctcgtcgggtctaccgaagctggagatggaggctagtaattagttactgacacgtctcgattagtgacgaggcaggctaagactaagttcgttacgtttcgggaacggtaacgggaccaacggcgtacggtacccgttcgttcgggcaacggcccgtaaggtcccgtccgcccccgtcggttcctaacccg

SEQ ID NO: 305652 - DNA, 589 bp, Homo sapiens
  misc_feature: GZ8MTXP01AE6XJ.2.35.D02.1.454.CMB.2.raw
  modified_base (372)..(372): a, c, t, g, unknown or other
  misc_feature (372)..(372): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacaacaccccggacgaacgcccccaaactcctcatttatgagtcacgtaagcggtcccttaggggtccctgactcgcttctctggccctcagtctggcaagacgcctccngcctctcgtggctacagcgtgagatgaggctagtattattacgtgacagtctacgagtagtcgacgacgacgacgacgtacgtacgtaagttcggtttaccggtttcggggaacgggtaacgggaaccgtacggccgtccggtacccgttccggttcgggttaccgaaccgtacccggaacggtcccgtcccggttccccgttccggttcccgtccg

SEQ ID NO: 305653 - DNA, 559 bp, Homo sapiens
  misc_feature: GZ8MTXP01EFGVH.2.35.D02.1.454.CMB.2.raw
  modified_base (302)..(302): a, c, t, g, unknown or other
  misc_feature (302)..(302): n is a, c, g, or t
  modified_base (443)..(443): a, c, t, g, unknown or other
  misc_feature (443)..(443): n is a, c, g, or t
  modified_base (515)..(515): a, c, t, g, unknown or other
  misc_feature (515)..(515): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgccgtccgggtctcctggacagtcagtcaccatctcctgcactggagcagcagtgacgttggcgttataactatgtctcctgtatcaacaacaccccggacgaacgcccccaaactcctcatttangaggtcactaagcggcccttagggggtcccctgatcgtcttctctggccctcaagtctggcaaacgaacgcctccctgaccgtctcgtcgggctcaagctgaggatcgaggctgtattattactgcagctgatatcgacgngcgagcagctaagtgttacgttttcgggaacggacgggaccaaagcgttacggaccgttccgttggttaccncggacccgaacggtccgtccgccccgtaacggttccgtaacccg

SEQ ID NO: 305654 - DNA, 551 bp, Homo sapiens
  misc_feature: GZ8MTXP01ENSS9.2.35.D02.1.454.CMB.2.raw
  modified_base (423)..(423): a, c, t, g, unknown or other
  misc_feature (423)..(423): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaacgcccccaaactcctcatttatgaggtcactaagcggcccttagggggtcccctgatcgcttctctggcctccaagtctggcaagaacggcctccctgacccgtctctcgggctccaagctgagatgagctgattattacngcagctcgatatgcaggcagcagactaaagttgttaacgttttcgggaacggtagggaccaaggcgtacggaccgttccgttgggttcaacgcccgaaggccgtcgcccccgtcggttccgtaacccg

SEQ ID NO: 305655 - DNA, 586 bp, Homo sapiens
  misc_feature: GZ8MTXP01AI836.2.35.D02.1.454.CMB.2.raw
  modified_base (248)..(248): a, c, t, g, unknown or other
  misc_feature (248)..(248): n is a, c, g, or t
  modified_base (449)..(449): a, c, t, g, unknown or other
  misc_feature (449)..(449): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgccccccaaactcctctatttatgagtcactaagcgtcccgttaggggtccctgactcgcttctctcggcctccaagtctggcaaaggaaccggccctcccgtgacccgtctcgtcgggcttccaagtctaggaggagtggaggcttagtatttatacgtgctagtctntaactgtcgcgagcgagcgagactattacggttacgttttcgggcgggtacgggaaccgaaagccgtacgtacccggttccgttcggggttaccgaacgcccgaacggtccgtccgcccccgtcggttcctaacccg

SEQ ID NO: 305656 - DNA, 568 bp, Homo sapiens
  misc_feature: GZ8MTXP01C6YCZ.2.35.D02.1.454.CMB.2.raw
  modified_base (308)..(308): a, c, t, g, unknown or other
  misc_feature (308)..(308): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttaataactatgtctcctggtatcaacaacaccccggacgaaacgacccccaaactccctactatttangaggtcacgtaagccggcccttagggggtccctgactcgtcttctcgtcggccctaccaagtctggcaacgaacggccctcctgacccgtctcgtcgggctccgaagctggagatgagctagtattatactgcagtctanatatgacgnggcagcaagctaaattcgttaccgtttcgggcggtaacgggacaacgcgtacgaccgttcgttcgggttacaacgacccaaggcctccgttccccgtcgttccgtaacccg

SEQ ID NO: 305657 - DNA, 579 bp, Homo sapiens
  misc_feature: GZ8MTXP01CFBMN.2.35.D02.1.454.CMB.2.raw
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactntgtctctggtatcaacaacaccccggcgaacgcccccaaactcctcatttangagtcactaagcgtcccgttaggggtccctgatcgtcttcnctggcctccagtctggcaagaaccggccctcccgtgacccgttctcgtcggggctccgaagcgtggaggngtggaggtctagtattattacgngacagtctactatagtcgcgaggcagcaagctaaagttcgttacgtttcgggaacgggtaacggacgaacgcgtacggacccgttcgttcgggttacgaacggcccgtaacggcctccggttcccccgtcggttaaccttcccg

SEQ ID NO: 305658 - DNA, 546 bp, Homo sapiens
  misc_feature: GZ8MTXP01AE08D.2.35.D02.1.454.CMB.2.raw
  modified_base (395)..(395): a, c, t, g, unknown or other
  misc_feature (395)..(395): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaacgacccccaaactcctcatttatgaggtcactaagcgccttaggggtccctgatcgcttctctggcctcagtctgcaagacgcctcctgaccgtctcgtgggctccaagctggagntgagctgtattatactgcagctcgatagtgcgaggcagcgagctaagtgttacgtttcgggaacggacgggttacaaggcgtacgtacccgttccgttggggttccaacggccccgaaggtccctcggttcccccgtcggttcctaacccg

SEQ ID NO: 305659 - DNA, 730 bp, Homo sapiens
  misc_feature: GZ8MTXP01EQ8ZL.2.35.D02.1.454.CMB.2.raw
  modified_base (311)..(311): a, c, t, g, unknown or other
  misc_feature (311)..(311): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgtacgttggcgttataactatgtctcgtgtatacaacaaccgaccccggacgaaaccgacccccaaactcctactatttagngacgtactacgtaagccggtacccgtttacggggtcccctagtactccgtcttctcgtcggtcccctaccgtaacgtcgtacgggacaaaccggtaacccggtccctacccgtacggtacccgttcgttccggtcggggtcctaccgaacgtcgtaggaaggtagtacggacggtacttaggttaaactttaacgttaacgtcgtacaacgtccttacgtaacgttagtacgacggaacggcaacggtaccgaaagtaccgttaaagttcggtttaccgggttttaccgggggaacgggaaccgggttaaaccgaacggttccgttaccgggtaacccggttccgggttcgggttacccaaccggaccccggtaacgggttcccgtaccccggttcccccgtccggttaacccttcccg

SEQ ID NO: 305660 - DNA, 643 bp, Homo sapiens
  misc_feature: GZ8MTXP01BBVEM.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgacccccaaactcctacatttatgagtcactaagcgcccgttacggggtccctgatcgcttctctcgcctccaagtctggcaacgaaccggccctcccgtgacccgtctcgtcgggctacccagctggacggagtggaggtctagtaatttacgttactgcctaagtcctacgtaattaagtcgacgagggaccaggaccgaagtaccgtaaagttacggtttaaccggttttcggggaaccgggtaacggggaacccgtaaaggttccgttacggtaaccccggttccgttcgggggttaccctaacgggccccgaaacgggtcccgtccgggttacccccccgttcgggttccctaaccccgg

SEQ ID NO: 305661 - DNA, 590 bp, Homo sapiens
  misc_feature: GZ8MTXP01D77HH.2.35.D02.1.454.CMB.2.raw
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaggcagcagtgacgttggcggttataactatgtctctgatatcaaacaacaccccggcgaacgccccccaaactcctcatttatgagtcactaagcggtcccttaggggtccctgatcgcttctctcggctcaagtctggcaagaacggcctcccgtgaccgtctcgtgggcctaccaagctgacggntggagctagattattacngtcagtctctatangcgagcagacgagtactaagttcggttaaccggtttcgggacgggaacgggtacccttaaaggtccgttacggttacccggttccggttacgggtaacccgaaccggccccggtaacggtcccgttacccgtcccccggttcgggttcccg

SEQ ID NO: 305662 - DNA, 607 bp, Homo sapiens
  misc_feature: GZ8MTXP01AE0K8.2.35.D02.1.454.CMB.2.raw
  modified_base (423)..(423): a, c, t, g, unknown or other
  misc_feature (423)..(423): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggacgaacgcccccaaactcctcatttatgaggtcactaagcggtcccttaggggtccctgactcgcttctctgccctcagtctgcaacgaccggcctccctgaccgtctcgtgggctccaagcgtgaggatgaggctagtattagttacngacacgtctacgtatcgtcgacgacggcacgacacgtactaagttcggttaccggtttcggggaacgggtaacgggaaccgaacggttccgtaccggtacccggttccgggttcgggttacccgaaccggtacccggtaacgggtcccgtaccccggttccccggttccggttaacccgtcccg

SEQ ID NO: 305663 - DNA, 606 bp, Homo sapiens
  misc_feature: GZ8MTXP01A4QHK.2.35.D02.1.454.CMB.2.raw
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtgacgttggcggttataactatgtctctggtatcaacacacccggcgaacgccccaaactcctcatttangtacggtcaactaacgcggtcccttacgggggtccctgactcgcttctctggcctccaagtcgtggcaaacgaccggccctccgtcgacccgtctcgtcgggcttaccgaagctaggacggtataggacggtcttagttattaacgttacgtgtacagtcttacgaattaacgtgccgagggccaggcagacctaaagttcgttaacgtttcgggaacgggtacggaaccacggcgttacggacccgttcggttcggttcgaacggcccgaagggtccctccggttccccgtaacgccttaacccg

SEQ ID NO: 305664 - DNA, 558 bp, Homo sapiens
  misc_feature: GZ8MTXP01C78TN.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctcatttatgagtcactaagcgccttagggtccctgatcgcttctctggcctccaagtctggcaacgaaccggcctccctgacccgtctcgtcgggctccaagctgaggatgaggctgtatttatactgcagctcggatagtgacgaggccagcaagctaaagttcgttacgttttcgggaacggtaacgggaccgtaagcgtacgaccggttcgttcgggttcaacgacccgaacggcctccggccccgttcggttaacctcccg

SEQ ID NO: 305665 - DNA, 535 bp, Homo sapiens
  misc_feature: GZ8MTXP01BSZ9G.2.35.D02.1.454.CMB.2.raw
  modified_base (398)..(398): a, c, t, g, unknown or other
  misc_feature (398)..(398): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaacgcccccaaactcctcatttatgagtcactaagcgcccttagggggtccctgactcgcttctctggcctccaagtctgcaacgaacgcctccctgaccgtctctgggctcagctgagntgagctgattatactgcagctcgatatgcaggcagcagctaaagtgttaccttttcggggcgtaagggaccaaagcgtaggtaccgttccgttgggttacaacgcccgaaggctccggcccctcggttcctaacccg

SEQ ID NO: 305666 - DNA, 540 bp, Homo sapiens
  misc_feature: GZ8MTXP01CJ92P.2.35.D02.1.454.CMB.2.raw
  modified_base (249)..(249): a, c, t, g, unknown or other
  misc_feature (249)..(249): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactntgtctcctggtatcaacaacaccccggcgaacgcccccaaactcctctatttatgaggtcactaagcggcccttagggggtccctgatcgcttctctggcctccagtctggcaagacgcctcctgacctctcgtcgggctcgagctgaggtangagctgattatactgcagctcattangcgaggcaggcaggctaagttcgttacgtttcgggcggtaacgggaccaaaggcgtacggccgttccgttgggttcaacgcccgaaggcctcggcccctcggttcctaaccg

SEQ ID NO: 305667 - DNA, 579 bp, Homo sapiens
  misc_feature: GZ8MTXP01BCJL2.2.35.D02.1.454.CMB.2.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (404)..(404): a, c, t, g, unknown or other
  misc_feature (404)..(404): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaaccaccccggcgaacgcccccaaactcctacatttangagtcactaagcgtccttagggtccctgatcgcttcnctggccctacagtctggacaacgaaccgtcctcctgacccgtctcgtgggctaccaagctggagntggaggcttagattagttactgcagtctcgatacgtgcgaggcacgcgagctaaagttcgttaccgtttcgggaacgggtaacggactaacggttcgtacggtacccgttccgttcggggttccaacgggccccgaaggtcccgtccggttcccccgtaacggttccctaacccg

SEQ ID NO: 305668 - DNA, 580 bp, Homo sapiens
  misc_feature: GZ8MTXP01EUEWG.2.35.D02.1.454.CMB.2.raw
  modified_base (301)..(301): a, c, t, g, unknown or other
  misc_feature (301)..(301): n is a, c, g, or t
  modified_base (459)..(459): a, c, t, g, unknown or other
  misc_feature (459)..(459): n is a, c, g, or t
  modified_base (496)..(496): a, c, t, g, unknown or other
  misc_feature (496)..(496): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaactcctcatttangaggtcaactaagccggtcccgtttaggggtcccctgactcgcttctctggcctccagtctggcaaacgaaccggccctccgtcgacccgtctcgtcggggcctaccgaagcgtggaggatggaggtctagtaacttatactgcagtctacgattagngacgaggcagcaagctaaagttcgttacgtttcgggnggaacggacctaagcgtacggtacccgttccggttgggttccaacggtcccgaaggcctccggcccccgttggttccctaaccg

SEQ ID NO: 305669 - DNA, 569 bp, Homo sapiens
  misc_feature: GZ8MTXP01EOVDL.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaacgcccccaaactcctcatttatgagtcactaagcggcccttaggggtccctgactcgcttctctcggccctccaagtctggcaacgaaccggcctccctgacccgtctcgtcgggctccaagctggagatgaggtctgtattatactgcagctacgattatcgacgaggcagacagctaagttgttacgttttcgggaacgggtacgggaccgaagcgtacggtaccgttccgttcgggttccgaacggacccgaacggtccgtccgttccccgtccggttcgtaacccg

SEQ ID NO: 305670 - DNA, 627 bp, Homo sapiens
  misc_feature: GZ8MTXP01DSABC.2.35.D02.1.454.CMB.2.raw
  modified_base (299)..(299): a, c, t, g, unknown or other
  misc_feature (299)..(299): n is a, c, g, or t
  modified_base (441)..(441): a, c, t, g, unknown or other
  misc_feature (441)..(441): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggacgttataactatgtctctggtatcaacaacacccgacgaacgccccaaactcctcatttangagtcactaagcgtcccttagggtccctgactcgcttctctcggcctaccagtcgtggcctaaacgaaccggtccctcccgtcgacccgttctcgtcggggactaccgaagctaggagatggagtcttagtatttagttacngactagtctactaattacgtcgacgaaggccagaccaaggacctaaagttcgtttaaccgtttcggggaacgggtaacggttaccgaaacggttccgtacgggtacccgttccggttcgggttaccaaccgggccccgtaagggtcccctcccggttaccccccggttcggtttaaccccgtcccg

SEQ ID NO: 305671 - DNA, 543 bp, Homo sapiens
  misc_feature: GZ8MTXP01BIFQ6.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccgcgaacgcccccaaactcctctatttatgagtcactaagccggtcccgttagggggtccctgatcgcttctctggcctccagtctggcaacgaaccggccctccctgaccgtctcgtggggctccaagctggaggatggaggctgtattattactgcagtctacgatatgcgaggcagcagctaatcgttacgtttgggcggtagggacctagcgtcggtaccgttcgttgggttcaacgcccgaaggcctccggccccttcggcctccg

SEQ ID NO: 305672 - DNA, 532 bp, Homo sapiens
  misc_feature: GZ8MTXP01ETNBB.2.35.D02.1.454.CMB.2.raw
  modified_base (426)..(426): a, c, t, g, unknown or other
  misc_feature (426)..(426): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaaacgccccccaaactcctcatttatgaggtcactaagcggccctttagggggtccctgactcgcttctctcggcctccaagtctggcaagaaccggcctccctgacccgtctctgggctccaagctgaggatgagctgtattattacngtcagctcgatatgcaggcagcagctaatgttacgtttcgggcggaggacaagcgtcgaccgttcgttgggttcaagcccgaagcctcgcccctcggttctaaccg

SEQ ID NO: 305673 - DNA, 605 bp, Homo sapiens
  misc_feature: GZ8MTXP01A5BED.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggacgaacgacccccaaactcctactatttatgaggtcactaagcggtcccgttaggggtcccctgactcgtcttctctcggccctccgaagtctgggccaaacgggaacccggtccctcccgtcgacccgttctcgtcgggctccgaagctggagacgtggagtctagtattatactgctagtcctagtatagtgcgaaggccagacgagactaaagttcgttaaccgtttcgggaacggaacgggaccgtaagttcgtacgtacccggttccgttcgggttcgaaccggcccgaacggtccgtccggttcccccgtcgggttcccttcccg

SEQ ID NO: 305674 - DNA, 617 bp, Homo sapiens
  misc_feature: GZ8MTXP01AIB5M.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgacccccaaactcctcatttangaggtcactaagcggcccttaggggtccctgactcgcttctctggccctccagtctggctaaacgaaccggccctcccgtgacccgtctcgtcgggctaccaagctaggaggatggaggctagtattattactgacagtctacgtatagtgaccgaggcgacgacgaacggacctaaattacggttaccgttttcggggaacgggtaacgggaacccgaaacggttccgtacggtacccggttccggttcggggttaccgaaccggacccggaacgggtcccgtcccggttcccccgttcggttcccttaaccccg

SEQ ID NO: 305675 - DNA, 520 bp, Homo sapiens
  misc_feature: GZ8MTXP01DBXJA.2.35.D02.1.454.CMB.2.raw
  modified_base (487)..(487): a, c, t, g, unknown or other
  misc_feature (487)..(487): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaaacgccccccaaactcctcatttatgaggtcactaagcggcccttaggggtccctgatcgcttctctggcctcagtctggcaagaacgcctcctgaccgtctctgggctcagctgaggatgaggctgattatactgcagctcatatgcaggcagcagctaatgtactttcgggcgtagggacaagcgtacgccgttccgttgggttcngaccccgaaggctcgcccctcggttcctaaccg

SEQ ID NO: 305676 - DNA, 722 bp, Homo sapiens
  misc_feature: GZ8MTXP01B44I0.2.35.D02.1.454.CMB.2.raw
  modified_base (307)..(307): a, c, t, g, unknown or other
  misc_feature (307)..(307): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcacgtggagcagcagtgacgttggcgttataactatgtctctgtatacaacaaccaccccggacgaaccgacccccaaactcctactatttangaggtcaacgtaacgcggtacccgttacggggtccctgtactcgtcttcgtctcggtccctaccaagttcgtcggacaaacggaacccggtcccttcccgtacggtaccccgttccgttcggtcggggaccttacccgaaacggtcgttagggacgggtagtacgggtagggtacgttaggttaattttaacgttaacgttacggactaacggttcccttacgtaaagttaacgtcggaccgaaacggccgaagaccgaagtaccgttaaagtttacggtttaaccggttttcggggaacgggtaaacgggaaccgtaacggttcgtaccggttacccggttccggttcgggttaccgaaccggaccccgtaacggtcccgttacccggttcccccgttccgttcccgttccccg

SEQ ID NO: 305677 - DNA, 516 bp, Homo sapiens
  misc_feature: GZ8MTXP01AOH0I.2.35.D02.1.454.CMB.2.raw
  modified_base (369)..(369): a, c, t, g, unknown or other
  misc_feature (369)..(369): n is a, c, g, or t
  modified_base (477)..(477): a, c, t, g, unknown or other
  misc_feature (477)..(477): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaacgcccccaaactcctcatttatgagtcactaagcgcccttaggggtccctgatcgcttctctggcctccagtctgcaagaacgcctcccngaccgtctcgtgggctccaagctgaggatggagctgtattatactgcagctcgatatgcgaggcagcagctaatgttacgtttcggcggtaggaccagcgtgacgcgngttcgggtcacgcccgaaggccttcgtccccttcggtcc

SEQ ID NO: 305678 - DNA, 554 bp, Homo sapiens
  misc_feature: GZ8MTXP01DLK6Q.2.35.D02.1.454.CMB.2.raw
  modified_base (346)..(346): a, c, t, g, unknown or other
  misc_feature (346)..(346): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaaacgcccccaaactcctacatttatgaggtcactaagcggcccttaggggtcccctgactcgcttcnctggtcctccaagtctggcaagaaccgctccctgaccgtctctgggctcctaagctgaggatgaggtctgtattatatgnagctgatatgcaggcagnaagctaaatgttacgttttcgggaacggtagggacccaagttcgtcgtaaccgttcgttcgggttacaacggacccaacggcctcggcccccgttcggttccgttaaccc

SEQ ID NO: 305679 - DNA, 555 bp, Homo sapiens
  misc_feature: GZ8MTXP01CKLPJ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagtctccctccgcgtccgggtctcctggacagtcagtcaccatctcctgcactggaggcagcagtgacgttggcggttataactatgtctctggtatcaacaacaccccggcgaacgccccccaaactcctctatttatgaggtcactaagcggcccttaggggtccctgatcgcttctctggcctccaagtctggcaacgaaccggtcctccctacgaccgtctcgtgggctccaagctgagatgaggctgtattatacgtgcagctcgatatgcaggcagcagctaagttgtaacgtttcgggaacggtaagggaccaagcgtacgccgttaccgttgggttaccaacgacccgtaacggcctccggcccccgtcggttcctaacccg

SEQ ID NO: 305680 - DNA, 573 bp, Homo sapiens
  misc_feature: GZ8MTXP01B3XWG.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaacgccccccaaactcctcatttatgagtcactaagcggtccccgttaggggtccctgatcgcttctctggccctccagtcgtggcaaagaccggccctccctgacccgttctcgtgggctccgaagctggaggatggaggctagtattattactgactagcttacgattagtcgacgaggcaggcagctaagtaggttaccgttttcgggaacgggtaagggttaccaaagcgtcggtaccgttccgttgggttccaacgcccgaaggcctccgcccccgtcggttcctaacccg

SEQ ID NO: 305681 - DNA, 718 bp, Homo sapiens
  misc_feature: GZ8MTXP01D3LN8.2.35.D02.1.454.CMB.2.raw
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttanaactatgtctctgtatcaacaacacccggacgaacgccccaaactcctctatttangaggtacaacgtaacggccggtacccgtttaggggtcccctgacgttcgtcctttctcgtggtcccctaccaaagtcgtcggaccaaacggaacccgggtcccttcccgtacgtacccgttctcgtcggggccttacccgaagtccgtaggacgggtataggacggtacgttagttaactttaacgttacttcggactaaacgtcttacctaaagttacgttacgacgaacgggtaccgaggacaaacggtactaaacgtttcgtttaaaccggttttccggggaacgggttaacgggttaaacccgaaacggttccgttaccggtaacccggtttcccggttcgggttacccgtaaccggtaccccggaaacggtccccgttacccggttcccccgttccgggttcccttaaccccg

SEQ ID NO: 305682 - DNA, 649 bp, Homo sapiens
  misc_feature: GZ8MTXP01DZPCV.2.35.D02.1.454.CMB.2.raw
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacacacccgcaacgccccaaactcctctatttangagtcactaagccggtccttaggggtcccctgactcgtcttctcgtcgcctccaacgtcgtcggaccaaacgaacccgtccctcccgtcgacccgttctccgtggggacctaccgaacgcgtaggaggagtggaggtacgtagtatttacgttaaccgtgacctagtccttacgtaagttagtcgacgacggacgaggacaaagtaccgtaagtttacggttacgttttacggggaaccgggtaacgggaacccgtaaacggttccggttacggtaaccccggttccggttcgggttaccgaaccggacccggtaacggtcccgtccggttcccccgttcggttccctaacccg

SEQ ID NO: 305683 - DNA, 551 bp, Homo sapiens
  misc_feature: GZ8MTXP01ETG5P.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccttgactcagcctccctccgcgtccgggtctcctggacagtcagtcaccatctcctgcactggaggcagcagtgacgttggcgttataactatgtctcctggtatcaaacaacaccccggacgaacgacccccaaactcctcatttatgagtcactaagcggcccttagggggtccctgactcgtcttctctggccctccaagtctggccaagaaccggcctccctgacccgtctcgtgggctcagctgaggatgaggctgtatttattactgcagctacgatatgacaggcagcagctaagttgttacgtttcgggcggtaacggaccaagcgtacgaccgttcgttcgggttccaaggcccgaaggcctccgccccgttcggttcctaaccg

SEQ ID NO: 305684 - DNA, 541 bp, Homo sapiens
  misc_feature: GZ8MTXP01CZ1VR.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaaacgccccccaaactcctcatttatgaggtcactaagcgcccttagggggtccctgatcgcttctctggccctccaaagtctcggctaaggaaaccggcccttccctgacccgttctcgtgggctccaaagctgaggatggaggctgtattattactgcagctcgaatatgcaggcagcagctaatgtactttggcggtaagggacaagctacggcgttaccgttggttacaacgccgaaggcctcgcccctcggctaacccg

SEQ ID NO: 305685 - DNA, 610 bp, Homo sapiens
  misc_feature: GZ8MTXP01DK9HV.2.35.D02.1.454.CMB.2.raw
  modified_base (248)..(248): a, c, t, g, unknown or other
  misc_feature (248)..(248): n is a, c, g, or t
  modified_base (406)..(406): a, c, t, g, unknown or other
  misc_feature (406)..(406): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgcccccaaactcctcatttatgagtcactaagcggcccgttagggtccctgactcgcttctctcggcctccaagtctggcaagaaccgccctccctgacccgtctctgggactccaagctagaggntgaggctagtatttatactgcagctacattagtgacgaggccaggacaggactaagtttcgttaccgttttcggggaaccggggtaacggggttaaacccaaaggcccgttacggtaaccccgggttccggttcggggttaccgaaccgggaccccgtaacgggtcccgttcccggccccccgttccgggttcccttaaccccg

SEQ ID NO: 305686 - DNA, 595 bp, Homo sapiens
  misc_feature: GZ8MTXP01D1RKG.2.35.D02.1.454.CMB.2.raw
  modified_base (249)..(249): a, c, t, g, unknown or other
  misc_feature (249)..(249): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggcgttataactntgtctctgtatcaacaacacccgcgaacgccccaaactcctcatttatgagtcactaacgcggtcccttaggggtcccctgactcgtcttctctcggtccctccaagtctggacctaaaggaaccgtccctccgtcgacccgttctcgtcggggctaccgaagcgtggacggagtggaagtctagtattatactgactagctcgattagtgacgaggcagtcaagctaagttcgtaaccgttttgggaacggtacgggaacctaagttccgtacgtaaccggttcggttcgggttccgaaccgaccggtaacgccgtaccggccccgttcgggttccttaaccccg

SEQ ID NO: 305687 - DNA, 556 bp, Homo sapiens
  misc_feature: GZ8MTXP01BG8KH.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgccccccaaactcctacatttatgacggtcactaagcgcccgttaggggtccctgatcgcttctctggcctccaagtctggcaagaaccgcctacccgtgacccgtctcgtcgggctacccaagctgaggatgaggtctgtattatactgcagtctacgatagtgacaggcagcagctaaagttcgttacgtttcgggcgggtaaggaccgaagcgtcgtaccgttcgttcgggttcaacggcccgaaggcctaccgccccgtcggttccgtcccg

SEQ ID NO: 305688 - DNA, 644 bp, Homo sapiens
  misc_feature: GZ8MTXP01BB15U.2.35.D02.1.454.CMB.2.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacacacccgcgaacgccccaaactcctactatttangacggtcaactaaggcggtcccgttaggggtccctgactcgcttctcgtcggccctaccgaagtcgtggaccaaacggaacccggtccctcccgtcgtacccgtcgtcgtcggggtcctaccgaagtcgtaggaggacgtggaacggtcttagtaatttacgttaacgtcgactacgtcctacgtaattagtcgacgacgggccaaggacctaaggacttaaacgtttcggtttaaccggttttcgggaacgggtaacggaccgtaacggttcgtacggtacccgttcggttcgggttaccaacggtcccgaaggtccctccggccccgtcggttccgttaacccg

SEQ ID NO: 305689 - DNA, 646 bp, Homo sapiens
  misc_feature: GZ8MTXP01EJXVE.2.35.D02.1.454.CMB.2.raw
  modified_base (466)..(466): a, c, t, g, unknown or other
  misc_feature (466)..(466): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtgacgttggcgttataactatgtctcctggtatcaaacaaccaccccggacgaacgcccccaaactcctacatttatggaggtacactaacgccggtacccgttacggggtccctgtactcgtctttctctcggtccctccaaagtcgtggaccaaacgaaccgtccctaccctcgacccgttcgtcgtcggggctaccgaagctaggacggatggagtcgttagtattattacgngtccaagtctactaagttacgtgaccgaggcacgcgaagtacctaattacggtttaccgtttcggggaaccggtaagggttaacccgaaacggttcgtacggtacccgttcccggttgggttacccgaaccggacccgtaacggtcccgtacccggcccccgttcggttccttaaccccg

SEQ ID NO: 305690 - DNA, 621 bp, Homo sapiens
  misc_feature: GZ8MTXP01AELK8.2.35.D02.1.454.CMB.2.raw
  modified_base (343)..(343): a, c, t, g, unknown or other
  misc_feature (343)..(343): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttatactatgtctctgtatcaacaacacccggcgaacgcccccaaactcctctatttatgaggtacactaagcggtcccgttagggggtccctgatcgcttcncgtcggcctccagtctggcaagaccgcctccctgacccgtctcgtcgggctaccagcgtgaggacgtggagctgtattattacngtcagctacgtatcgtagccgaaggcaacgcaagtaccgtaagttacggttacggttttccggggaaccgggtaacgggttaaacccgaaacggttccgtacggtaacccggttccggttcgggttaccccgaacggtaccccggaacggttcccgtccccggttcccccggtttaaccggttcccgttccccg

SEQ ID NO: 305691 - DNA, 549 bp, Homo sapiens
  misc_feature: GZ8MTXP01AN7SD.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgccccccaaactcctcatttatgaggtcactaagcggcccttagggggtccctgatcgcttctctggcctccaagtctggcaagaaccgcctcccgtgaccgtctcgtggggctccaagctggaggatggagctgtattattactgcagtctcgatagtgacagcagcagctaagtgtacgtttcgggcggacgggacaagcgtacggaccgttccgttggggttccaacggcccgaacggccgtccggcccccgtcgggttcctcccg

SEQ ID NO: 305692 - DNA, 566 bp, Homo sapiens
  misc_feature: GZ8MTXP01BYV3F.2.35.D02.1.454.CMB.2.raw
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (411)..(411): a, c, t, g, unknown or other
  misc_feature (411)..(411): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttgcgttataactatgtctctggtatcgaacaacaccccggcgaacgcccccaaactcctntactttangacgtcactaaggcggcccttaggggtccctgactcgcttctcgtggtcccctcaagtcgtgcaacgaaccggcctaccctgacccgtctcgtgggctacagcagtagntcgaggtctgtattatactgacagtctacgtatagtgacgaggcaggcaaggactaagttgtaaccgttttcgggaacggtacgggacgaacgcgtacgccgttacgttcggttcgaacgcccgaacgccgtccgttccccgtccggttctcccg

SEQ ID NO: 305693 - DNA, 614 bp, Homo sapiens
  misc_feature: GZ8MTXP01DF0J2.2.35.D02.1.454.CMB.2.raw
  modified_base (466)..(466): a, c, t, g, unknown or other
  misc_feature (466)..(466): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctgtatcaacaacaccccggcgaacgcccccaaactcctactatttatgacggtcaactaaacggccggtcccgttacgggggtccccttgacttcgtcttctcgtcggtcctccaagtcgtcggacaaacgaaccgggccctcccgtcgacccgttctccgtcggggcctaccgaagtcgtaggaggagtggaggtactgtaatttattacgngctagctacaattagtgcgagcagcaagtactaagttcgttacgtttcgggaacgggacggttaccaaagccgtacggaaccgttcggttcgggttaccgaacggacccgaacggtccctcccggccccgttcggttcccgtaacccg

SEQ ID NO: 305694 - DNA, 626 bp, Homo sapiens
  misc_feature: GZ8MTXP01AGYS1.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcggttataactntgtctctggtatcaacaaccaccccggacgaaccgacccccaaactccctactatttatgacggtcaactaaggccggtaccccgttagggggtccctgactccgtcttctcgtcggccctaccgagtctcggcaaacggaaccgtccctcccgtcggacccgttcgtcgtcggggacctaccgaacgtcgtaggacggagtggaggtctgtattattactgcacgtctacgtatatgcgaggcagcagctaagttcgttacgtttcgggaacgggaacgggaccgaacgttccgtacggtacccggttccggttcgggttccgaaccggtcccgaacgggtcccgtcccggttcccccgttcggttcccgtaacccg

SEQ ID NO: 305695 - DNA, 607 bp, Homo sapiens
  misc_feature: GZ8MTXP01CJ6PI.2.35.D02.1.454.CMB.2.raw
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctctggtatcaacaacaccccggacgaacgacccccaaactcctactatttanagtacggtacacgtaaacgccggtaccctttagggggtccctgacgtcgtcttctcgtgccctccaagtctaggctaacggaacccggtcctcccgtgacccgttctccgtgggtctaccgaacgtctaggagagtggtaggacttgtaacttagttactgtacagtctanagttagngcgaggaccagacgacgactaagttcggttaccgtttcggggaacggtaacggactaaacgcgtacggtaccgttcgttgggaccaacggcccgtaacgctcccggcccctcggttaacctccg

SEQ ID NO: 305696 - DNA, 630 bp, Homo sapiens
  misc_feature: GZ8MTXP01C13GJ.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacaacacccggcgaacgcccccaaactcctactatttangagtcactaaggccgtcccgttaggggtcccctgactcgtcttctcgtcggccctaccagtctaggcaaacggaacccggtccctcccgtgacccgttctccgtcggggcctacccgaagtcgtggaggtagtggaggtcttagtatttaacgttactgactagtctacgtattagtcgacgaggccgagacagactaaagttcgttaccgttttcgggaacgggtaacgggaacctaacggccgtacggtacccggttccggttcggggttaccaaccggtacccgaacggtcccgtacccggcccccgttcgggttcccttaacccg

SEQ ID NO: 305697 - DNA, 538 bp, Homo sapiens
  misc_feature: GZ8MTXP01DZ4WX.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaaacgccccccaaactcctcatttatgaggtcactaagcggcccttaggggtccctgatcgcttctctggtccctccaagtctgcaaggaaccgccctcctcgacccgtctcgtcgggctccgagcgtggaggatggaggctgtattattactgcacgctacatagtgacgaggcagcagctaaatgtacgtttcggcggtaggacagcgtgaccgttcgttggttcaacgccgaacggctccgcccgtcgttcgtaaccg

SEQ ID NO: 305698 - DNA, 708 bp, Homo sapiens
  misc_feature: GZ8MTXP01DHZB6.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttaatactatgtctcctggtatcaaacaacaccccggacgaaacgcccccaaaactcctacatttatgagtcactaagcggccgttaggggtccctgatcgcttctctggcctccaagtctggcaacgaaccggcctaccctcgtacccgtctccgtcggggtcctaccaagtcgtaggacgggatggaacgggacttaggtaactttaacgtttacgttacgacgtacgtcccgttacgtaattaacgttcggacccggaagggtccgaacggacgtaaacggtaccttaaaggtttcggtttaccggtttttacgggggaaccgggtaacggggttaaacccgtaaacggttccgtttaacgggaacccggttcccggttcgggggttaaccccgaacgggtaaccccggtaacggggtcccggttccccggttaccccccggttcgggttcccctttaaccccgg

SEQ ID NO: 305699 - DNA, 555 bp, Homo sapiens
  misc_feature: GZ8MTXP01EP9B5.2.35.D02.1.454.CMB.2.raw
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (445)..(445): a, c, t, g, unknown or other
  misc_feature (445)..(445): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctctggtatcaaacaacaccccggcgaaacgcccccaaactcctcatttangagtcactaagcgccttagggtccctgactcgtcttctctggccctaccaagtctggctaacgaacggcctccctgaccgtctctggggctacaagctgagatgagctgtattacttactgcagtctacgtatatgcgaggcngcagactaaattgttacttttcgggcgggaaggaccgaaagcgtacggtaacccgttccgttgggttaccgaacgacccgaaggccgtcgcccccgtcggttctaacccg

SEQ ID NO: 305700 - DNA, 772 bp, Homo sapiens
  misc_feature: GZ8MTXP01A0ADJ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtgacgttggcgttataactatgtctctggtatcaaacaaccgaccccggacgaaacgaccccccaaactccctactatttatgacggtacaactaacgcggtcccgttaggggtccctagactcgtctttctcgtcggccctaccgtaagttccgtgggacctaaacggaaacccgggtccccttaccccgtacgggtaccccgttccgtccggtcgggggcccttacccgaaagtccgtagggaacgggtagtacgggaacgggtaccgttaggttaatttaacgtttaccgacgtaccgtaacggtccttacggtaacttagtacggaccggaagggtccaaggaccgaacggtacctaaagtttacggtttaccggttttaccgggggaaccggggtaacggggttaaacccgaaacggttaccggttaccgggtaaccccggttaccggttccggggttacccggaacccggaccccggtaaaccgggtccccgtaccccgggttacccccccgttccgggttccccgttaaccccgg

SEQ ID NO: 305701 - DNA, 663 bp, Homo sapiens
  misc_feature: GZ8MTXP01CZ5Z2.2.35.D02.1.454.CMB.2.raw
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccactcctcngcngnggacgcagctagtcgtacggttggtacgttaataactgtcgtcctcgtagtacacaacacccgccggacgaccaccctaactcctattattngacgtacaacgtacggcccgtaccggttcggtcctgactccgttcttcncgtcgtccctacgtagtcgtacgacgaaaccgggtacccgtcccttccgtaccggtcccgttcgtcgggcggtccctaacgacgtcgtaggacggtgtacgggacgtcttagttaatttacttacgngacgtactacctagtaatggtcgacgngacgacgacgacgtaacgttagttacggtttacgttcgggggaacggtaaccggaactacggttcgtaccggttacccgttcgggttcggaccgaacccggtaaccgtcggtcccgtcccccggttcccgttccgttaacccgttcccg

SEQ ID NO: 305702 - DNA, 594 bp, Homo sapiens
  misc_feature: GZ8MTXP01ATW2S.2.35.D02.1.454.CMB.2.raw
  modified_base (290)..(290): a, c, t, g, unknown or other
  misc_feature (290)..(290): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctgtatcaacacacccggcgaacgcccccaaactcctntatttatgagtcactaagcggcccgttaggggtccctgactcgtcttctctggccctaccagtcgtggacaaacggaacccggtccctcccgtcggacccgttctacgtcggggcctaccgaagcgtaggaggactggaggtctagtattatactgcagtcctagatgtgacgaggcacggacacgtactaagttcgttaccgtttcgggaacgggtacggaccgaagttcgtaccggtaaccgttccggttcgggttaccaacggcccgaaggtccctcccggcccccgttcggttcctcccg

SEQ ID NO: 305703 - DNA, 592 bp, Homo sapiens
  misc_feature: GZ8MTXP01C0BL2.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaacgacccccaaactcctcatttatgaggtcactaagcggcccgttacggggtccctgatcgcttctctggcctccaagtctggcaacgaaccggccctcccgtcgacccgtctcgtcgggtctccgaagtcgtaggaggatcggaggcttagatttagtactgcagtctcgaatactagcgaggcaggcaggctaaagttcgttacgtttcgggaacggtaacggggacccaaaggccgtacggtacccggttccgttcgggaccgaacggacccgaacggtcctccggttcccccgttcgggttcctaacccg

SEQ ID NO: 305704 - DNA, 663 bp, Homo sapiens
  misc_feature: GZ8MTXP01EJDL2.2.35.D02.1.454.CMB.2.raw
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcactggaggcagcagtgacgttggcgttataactntgtctctgtancaacacacccggcaacnccccaaactcctatatttangagtcactaacgcggtccgttagggtccctgtactcgtcttcncgtcggccctaccgagtctggaccaaacggaccgccctccgtcgtacccgtctcgtcggggcctaccgaagtcgtaggaggagtaggtacggtacttagttactttacgttacgtcgctagtcttacgaattagtcgacgacggacaacggcaaacggtactaaacgtttcggtttaccggtttcggggaaccgggtaaacgggttaacccgaacggttccgtaccgggtaaccccggttccggttacggggttacccgaacccggtaccccggtaaggtccccgttccccggcccccgttaaccggttcccgttaaccccg

SEQ ID NO: 305705 - DNA, 547 bp, Homo sapiens
  misc_feature: GZ8MTXP01EKQ0C.2.35.D02.1.454.CMB.2.raw
  modified_base (437)..(437): a, c, t, g, unknown or other
  misc_feature (437)..(437): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcaaacgacccccaaactcctcatttatgaggtcactaagcggcccttagggggtccctgactcgcttctctggccctccaagtctggcaacgaacggccctccctgacccgtctcgtcggggctcccgaagctgaggatgaggtctagtattatactgcanctcgatatgacaggcagtcagctaaatgtacgtttcggcggagggaccaagcgtgtaccggttcgttgggttccaagccccgaagggtcctcggcccctcggttctcccg

SEQ ID NO: 305706 - DNA, 590 bp, Homo sapiens
  misc_feature: GZ8MTXP01CFCA4.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgcccccaaactcctctatttatgagtcactaagcggcccttaggggtccctgacttcgcttctctcggcctcagtctggcaagaaccggcctcccgtgacccgtctcgtcggggcctaccaagcctggaggactggagtcgttagtatttagttactgtacagtctcgatatgacgaggccagcagctaagtgttacgtttcgggaacgggtacgggaccaaaggccgtcggtacccgttccggttcgggttccgaaccggtaccccgaagggtcccgtacccggccccccgttcgggttccctaacccg

SEQ ID NO: 305707 - DNA, 617 bp, Homo sapiens
  misc_feature: GZ8MTXP01AHG39.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgccccccaaactcctcatttatgagtcactaagcggcccttagggggtccctgatcgcttctctcggcctccaagtctcgggctaaacgaaccgggccctccctgacccgtctcgtggggcctaccaagctgaggatgaggtctgtattattactgcagctacgatatgaccgaaggccagaccgaggacctaagttaggttaccgttttacgggggccggaaagggggttacccaaaggttccgttacggaaccccggttccgtttcgggggttccaacgggaccccctaaaggggtcccctccggttcccccccgtccggggttcccttccccgg

SEQ ID NO: 305708 - DNA, 600 bp, Homo sapiens
  misc_feature: GZ8MTXP01BXO8O.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacaccccggacgaaacgcccccaaactcctctatttatgacggtcactaagcggcccgttacggggtccctgactcgcttctctcggccctaccagtctggcaacgaacggccctccgtgacccgtctcgtcgggctaccaagctggaggatgaggctagtattattactgcagctacgatagtgacgacggacaggccaagctaagttcgttaacgttttcgggaacgggtaacgggaaccgtaaacggttcgtacggtaacccgttccggttcgggttccgaaccggtacccgaacgggtccgtccggttcccccgttcggttcccttaacccg

SEQ ID NO: 305709 - DNA, 590 bp, Homo sapiens
  misc_feature: GZ8MTXP01D3D8D.2.35.D02.1.454.CMB.2.raw
  modified_base (460)..(460): a, c, t, g, unknown or other
  misc_feature (460)..(460): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcgaaacgccccccaaaactccctacatttatagaggtcaacgttaacgcggtccccgtttagggggtcccctggatcgtcttctctcggtcctccaagtctggcaagaaccggcctccctgaccgtctctgggctccaagctgaggatgaggctgaattatactgcagtctcatatgcaggcagnagtcaaagttcggttaacgtttcgggaacgggtaaagaccgtaaacggttcgtacggtaacccgttccggttgggttaccaacggtacccgaacgggtcctccggttcccccgttaacggttccttcccg

SEQ ID NO: 305710 - DNA, 676 bp, Homo sapiens
  misc_feature: GZ8MTXP01EXR4N.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaggcagcagtgacgttggcggttataactatgtctctggtatacaacaaccaccccggacgaacgacccccaaactcctactatttatgaggtcacgtagccggtaccccgttaggggtccctgactcgtcttctcgtcggccctccgaagtcgtggcaacgaaccggccctcccgtcggcccgtctcgttcggggcctaccgaagcgtggaaggtagtggaggtcgtagtatttaacgtttacgtcgtacgacgtcctacgatagtcgacgacggacgacgacacgtaacgtaagttacggttaccggttttcggggtaacggggtaacgggaaaccgaaacggttcgtaacccgggttcaaaccgggggttccccttacggggggttcccccgaaagggccccccgtaacggggtcccccgttacgggtccccccccttcccggggtttcccg

SEQ ID NO: 305711 - DNA, 610 bp, Homo sapiens
  misc_feature: GZ8MTXP01B3G2U.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccgcgaacgacccccaaactcctctatttatgaggtcactaagccggtacccgttagggggtccctgactcgctttctcgtggccctaccagtctcggctaaggaacccggcccttccctgacccgtctcgtcggggcctaccaagcgtgaggatggaggctgtatttacttactgcagtctacgtataacgttgaccgaggccgagacgacgactaagttcgttaacgttttcgggaacgggtaacgggaccgaaacggttcgtacggtacccgttccgttcggttaccgaacggacccgaacggtcccgtccggttcccccgtcggttcccgtaacccg

SEQ ID NO: 305712 - DNA, 571 bp, Homo sapiens
  misc_feature: GZ8MTXP01AOFX1.2.35.D02.1.454.CMB.2.raw
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagccctccctccgcggtccgggtctccgtggacagtcagtcaccatctcctgcacgtggagcagcagtgacgttggcgttatactntgtctctgtatcaacaacacccggcgaacgaccccaaactcctctatttangacggtcacgtaacgccggtcccgttaggggtccctgactcgtcttctctcggcctccagtctggcaagaaccgcctccngacccgtctcgtgggctccgaagctaggacggatggacggtctagtattattacgtgctagctacgattagtgcgaggcagcagcctaagttcgttacgttcggcggtaaggacccgaagcgtacggccgttaccggttggttaccgaacgcccgaaggccctaccggccccgttcggttctaacccg

SEQ ID NO: 305713 - DNA, 574 bp, Homo sapiens
  misc_feature: GZ8MTXP01BZDNX.2.35.D02.1.454.CMB.2.raw
  modified_base (248)..(248): a, c, t, g, unknown or other
  misc_feature (248)..(248): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacaccccggacgaacgcccccaaactcctcatttatgaggtcactaagcggtccccttaggggtcccctgatccgcttctctggccctccagtctggcaacgaaccgcctccctgacctctcgtcgggctacgagctaggaggatgaggtctgtattatacgngcagctcatatgcgagcagcagctaattggttaaccgtttcgggaacggtaacgggacccgaagttccgtacggtacccgttccggttcgggttaccaacggccccgtaagggccctacccggcccccgttcgggttccctaacccg

SEQ ID NO: 305714 - DNA, 604 bp, Homo sapiens
  misc_feature: GZ8MTXP01AMF50.2.35.D02.1.454.CMB.2.raw
  modified_base (444)..(444): a, c, t, g, unknown or other
  misc_feature (444)..(444): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgcccccaaactcctcatttatgaggtcaactaagccggtcccgttagggggtccctgactcgtcttctcgtggccctccgaagtctggcaaacgaaccggccctcccgtcgacccgtctcgtcgggctacccaagctggaggatgaggtctgtatttatactgacngctcgatatgacagacagcaagctaaattcggtttaaccgttttcggggaacgggtaacgggaaccgtaaacgttccgtacggtacccgttccggttcgggttccaaccggaccccgaacgggtcccgtcccggccccccgttcgggttccctaaccccg

SEQ ID NO: 305715 - DNA, 581 bp, Homo sapiens
  misc_feature: GZ8MTXP01D5CJW.2.35.D02.1.454.CMB.2.raw
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (463)..(463): a, c, t, g, unknown or other
  misc_feature (463)..(463): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttanactntgtctctgtatcaacaacacccggacgaacgcccccaaactcctactatttatgaggtcactaagccggtcccgttagggggtcccctgactcgtcttctcgtcggccctaccgaagtcgtggcaaacgaaccggccctccctgacccgttctcgtcgggcctaccgaagctggacggatgaggtctagtattagttaactgcagcctagattangcgaaggcagcaagctaaagttcgttacgtttcgggcggaacggacctaaggcgtacggtaccgttcgttgggttccaacgcccgaaggtccctaccgccccgtcggttcctaacccg

SEQ ID NO: 305716 - DNA, 590 bp, Homo sapiens
  misc_feature: GZ8MTXP01BDGN8.2.35.D02.1.454.CMB.2.raw
  modified_base (296)..(296): a, c, t, g, unknown or other
  misc_feature (296)..(296): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacacacccgcgaacgccccaaactcctctatttangagtcactacgcggtcccgttaggggtccctgacttcgcttctcgtcggtccctaccgaagtctgggacaaacggaaccgggtccccttcccgtcggtacccgttccgtccggtcggggtcccttacccgaaagtccgtaggacggtagtacggaaggtcttagtaatttacgttacgtgctagtctcgtaattagtcgaggcagcagactaattcgttacgtttcgggcggaaggacaggtcgttcgaccgtcgttggcacgtcccgagcctccgcccttcgtccttcgtccg

SEQ ID NO: 305717 - DNA, 569 bp, Homo sapiens
  misc_feature: GZ8MTXP01B3FAN.2.35.D02.1.454.CMB.2.raw
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacaccccggcgaacgcccccaaactcctcatttangagtcactaagcggcccttagggggtccctgactcgcttctctggccctccaagtcgtggcaacgaaccggccctccctgacccgtctcgtcggggctcccaagctggaggatggaggtcttagtatttacttactgctagctcgtatatgacaggcagcagctaaagtgttacgtttcgggcggtaacgggaccaaggcgtacggacccgttcgttgggttccaacgcccgaaggtcctccggttcccccgtaacgggttcctaacccg

SEQ ID NO: 305718 - DNA, 623 bp, Homo sapiens
  misc_feature: GZ8MTXP01AGHMI.2.35.D02.1.454.CMB.2.raw
  modified_base (305)..(305): a, c, t, g, unknown or other
  misc_feature (305)..(305): n is a, c, g, or t
  modified_base (443)..(443): a, c, t, g, unknown or other
  misc_feature (443)..(443): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatacaacaaccaccccggcgaaacgccccccaaactcctcatttangagtcactagcgcctagggtccctgactcgtcttctctggcccctccaagtctggcaaagaacccgggtccctcccgtgacccgttctccgtggggcctcccgaagccgtggaggatggagctagatttattactgcngctcgtatatgcgaggcagctagacctaaagttcgttaaccgttttcgggaacgggtacgggaaccgaaaggttcccgtcggtaacccggttcccggttcggggttacccgtaacgggtaccccgaaccgggggtccctaccccgggttccccccggtccggggttccccttaaccccgg

SEQ ID NO: 305719 - DNA, 555 bp, Homo sapiens
  misc_feature: GZ8MTXP01BRYN5.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaaacgcccccaaactcctcatttatgagtcactaagcggccttaggggtcccctgactcgcttctctggcctccaagtctggcaagaaccggccctccctgacccgtctcgtcggggcctccaagctagaggatggaggtctgtatttattactgacagctcatatgcaggcagcagctaaatgttacgtttcgggcggaacgggttaccaagcgtggtaacccgttcgttgggttccaacgcccgaacggccgtccgccccgtcggttcctaaccg

SEQ ID NO: 305720 - DNA, 554 bp, Homo sapiens
  misc_feature: GZ8MTXP01EMSBK.2.35.D02.1.454.CMB.2.raw
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaaacaacaccccggcgaaacgccccccaaactccctctatttatgaggtcactaagcggtcccttaggggtcccctgatcgcttctctggccctccaagtctggcaaacggaaccggccctcccttgacccgtctcgtcggggctccaagctagaggatgaggctagtattatactgcagcttanatgngngagnagcagctaagttcgttacgttcggaacggacggacagcgtacgtaccgttcgttcggttacaacgaccgaacggtcctccgccccttcgttcctaacg

SEQ ID NO: 305721 - DNA, 623 bp, Homo sapiens
  misc_feature: GZ8MTXP01E1642.2.35.D02.1.454.CMB.2.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggacgttataactntgtctctggtatcaacaacaccccggcgaacgccccaaactcctcatttangagtcaactaagccggtcccgttagggggtcccctgtactcgtcttctcgtcggccctaccagtcgtggactaacggaaccgccctcccgtcgacccgttctcgtcggggtcctaccgagtcgtggaggagtggagtacgtgttattagttactgctagtactacggtatagtcgcgagcacgcagtactacgttgttaccggttttcgggaacgggtaacgggaaccgtaacggttccgtacggtacccgttccggttcgggttaccgaaccggtacccgaacggtcccgtccggttcccccgttcgggttcccttaacccg

SEQ ID NO: 305722 - DNA, 584 bp, Homo sapiens
  misc_feature: GZ8MTXP01DIYBE.2.35.D02.1.454.CMB.2.raw
  modified_base (249)..(249): a, c, t, g, unknown or other
  misc_feature (249)..(249): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (531)..(531): a, c, t, g, unknown or other
  misc_feature (531)..(531): n is a, c, g, or t
  modified_base (541)..(541): a, c, t, g, unknown or other
  misc_feature (541)..(541): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttaataactntgtctctggtatcaacaacaccccggcgaaacgaccccccaaactcctacatttatgaggtacactaagcggtcccttaggggtccctgactcgcttctctcggcctccaagtctggcaaacggaaccggccctcccgtcgacccgttctcgtcggggccttaccaagctaggaaggatggaggtctgtaacttatacctgcaagcctnaattntgcaggcagcaagctaatcgttacgtttcgggaacggtagggacctaagttcgtcggtacccgttcgnggggttaccncggacccgaacggcctccggccccttcgggttcccttaacccg

SEQ ID NO: 305723 - DNA, 594 bp, Homo sapiens
  misc_feature: GZ8MTXP01AD2D7.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaaccaccccggacgaacgcccccaaactcctactatttatgagtcaacgtaagccggtcccgttagggggtccctgactcgtcttctctcggcctaccagtcgtcggactaaacggaaccggccctcccgtcgaccgtctcgtcgggcctccaagtcgtggaggactggagggtactgtaattattacgttcgctagtctacgtatacgtgacgaggcagacagctaagttcggttacgtttcgggaacgggtagggaccgtaagcgtacggtaccgttccgttcgggaccaacggccgaacggtctccgttccccgtggttcctaaccg

SEQ ID NO: 305724 - DNA, 572 bp, Homo sapiens
  misc_feature: GZ8MTXP01DUHR5.2.35.D02.1.454.CMB.2.raw
  modified_base (248)..(248): a, c, t, g, unknown or other
  misc_feature (248)..(248): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacacccgcgaacgcccccaaactcctacatttatgagtcactaacgcggtcccttagggggtccctgactcgtcttctctcggcctaccagtctggcaacgaaccgcctccctgacccgtctcgtcgggctaccagctgaggatgngtctgtattattacngctagctacatatgacaggcagcagctaaagttcgttacgttttcgggcggtaacgggaccgtaaacgccgtacggtacccgttccgttcgggttaccaacggaccccgtaacggtcccgtccgcccccgtcggttccctaacccg

SEQ ID NO: 305725 - DNA, 653 bp, Homo sapiens
  misc_feature: GZ8MTXP01AS379.2.35.D02.1.454.CMB.2.raw
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacaacacccggcaacgcccccaaactcctcatttangagtnactagcgtccgttagggtccctgactcgcttctctcggccctccaagtctggccaaagaacccggcctcccgngacccgttctcgtcggggctaccgaagctaggagggatgggaaggtcttagtactttatacgtgaccagtctacgtatagtcgcgaacggcgacggccaaaggtacctaaggtttacggtttaaccggtttttcccgggggaacggggtaacgggttaacccgaaaggttccgtaccgggtaacccggttcccggttcggggttacccaacccgggttaccccggaacgggtccccgtttcccgggacccccccggttcgggttcccctttccccgg

SEQ ID NO: 305726 - DNA, 610 bp, Homo sapiens
  misc_feature: GZ8MTXP01ENOAS.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgcccccaaactcctacatttatgagtcactaagcggtcccgttaggggtccctgactcgtcttctcgtcggccctaccgaagtcgtggccaaaggaaccggccctcccgtgacccgttctcgtcggggctccagtctaggaggatgaggtctagtattattactgcagtctacgatagtgcgaggcagcgaagtcgtaaattcggttaccgttttcggggaacgggtacgggaaccgtaaacggttcgtacggtacccggttccggttcggggttacgaaccggtaccccggaaggtcccgtccggttcccccgttccggttccttaacccg

SEQ ID NO: 305727 - DNA, 748 bp, Homo sapiens
  misc_feature: GZ8MTXP01B56M4.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgacccccaaactcctactatttangacgtcaacgtaacgccggtcccgtttaacgggggtccctgactccgtcttcgtcgtcggtccctaccgtaagtcgtacggaccaaacgggaacccggtccctcccgtacggtaccccgttctccggttcggggacccttacccgaaacggtcgttacgggaacgggtacgttagggaacgggttccgttaacggttaattttaacgtttacgtcggacctaacggtaccctttacgtaaagttaacgttcggacgaacggggtcaacgggactaacggtactaaacgtttcgggtttaacccggttttcgggggaaccggggtaaacgggttaacccgtaaacggttccgtaaccgggtaccccggttaccggttcgggggacctaaccggaccccggaacggtcccgtcccgggttacccccgttcgggttaacccgttccccg

SEQ ID NO: 305728 - DNA, 599 bp, Homo sapiens
  misc_feature: GZ8MTXP01DRB23.2.35.D02.1.454.CMB.2.raw
  modified_base (303)..(303): a, c, t, g, unknown or other
  misc_feature (303)..(303): n is a, c, g, or t
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttgcgttataactatgtctctgtatacaacaacaccccggacgaacgacccccaaactcctacatttangagtcactaacgcggtacccttagggtccctgactcgtcttctctggccctcaagtcgtggacaacggaaccgtccctcctcgacccgttcctcgtcgggctaccagctggagntgagctagtattatactgcagtctacgtatagtcgacgaggccagacaacgataagttacgttacggtttcgggaacgggtaacgggaacctaacggttcgtcggtaacccggttccgttcgggttccaacggaccccgtaaacggtcccgtccgttcccccgttcggttccgttaaccccg

SEQ ID NO: 305729 - DNA, 699 bp, Homo sapiens
  misc_feature: GZ8MTXP01CKJRX.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcagtcacatctctgcacgtggagcagcagtgacgttggacgttataactntgtctctgtatacaacaaccaccccggacaaacgacccccaaaactcctactaattttagcggaacgttaccaacgtaaacggccggtaccccggtttaacgggggtcccctaggtaacttccggtctttccgtcgtacgggacccccttaccgaaagttccgtagggaccaaaaccgggaaaccgggtccctacccgtgtacccggttcgtcgtacggggccttaccgaagtccgtaggaagagtggagtacgttaggtaatttacgttaacgtcgtactacgtactacgtaagtacgtagacgaagacgacgacgaacgtacgttaagttacggtttacggttacgggaacggtaaacggacgtaacgttcgtacgtaccggttcggttcggaccgaaccggaccggtaacggtcccgtcccgttaccccgttcgttcccgtaaccg

SEQ ID NO: 305730 - DNA, 685 bp, Homo sapiens
  misc_feature: GZ8MTXP01CP072.2.35.D02.1.454.CMB.2.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacaacacccggacgaacgccccaaactcctntatttangagtcacgtaacggccggtaccgttaggggtccctggactcgtcctttctctcggtcccctaccgaagttctggaccgaaacgaaccggtccctcccgtacgtacccgttctccgtcgggtcctaccgaagtcgtaggaggtacgtggaacggtcttagtaatttacgttacgtgacgtacgtacctacggtaactttagcggtacgacgggacaacgtacgaaacggtacttaaacggtttcggttttaaccggtttcgggggaaccggggtaaacgggttaaccgtaacggttccgtaccggtaccggttcccggttgggttacccgaaccggtacccggtaacggtcccgtccgttcccccgttaacggttcccgtaacccg

SEQ ID NO: 305731 - DNA, 649 bp, Homo sapiens
  misc_feature: GZ8MTXP01EB2J4.2.35.D02.1.454.CMB.2.raw
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcacgtggagcagcagtgacgttggcgttataactntgtctctgtatcaacaacacccgcaacgccccaaactcctctatttangagtcactaagcggtccctttagggggtccctgtactcgtcttctcgtcggtccctaccgaagttccgtgggaccgaaacgggaaacccgggtcccttaccccgtacgggtaacccgttccgttccggtacgggggccttacccgaaacgtccgttaggaagggatgggaggtccgttagtaagtttacttacgtcgacagtctcagttattcgacgaggcagcgtaagctaaagttcggttacgttttcggggaacggtaacgggaccaaacggttccgtaggtcccgttacgttcgggttaccgaaccggaccgaacggtcctcccgttccccgtccggttccttaacccg

SEQ ID NO: 305732 - DNA, 618 bp, Homo sapiens
  misc_feature: GZ8MTXP01EWN9C.2.35.D02.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaaccaccccggacaacgacccccaaactcctctatttangagtacactaaggccggtcccgttagggggtccctgtactcgtcttctctcggccctaccgaagtcgtggaccaaacggaaccggtccctcccgtcgacccgtctcgtcgggctacccgaagtcgtaggaggagtggaggtcgttagtaatttactaaccgtgactagtcctacgtaatttagcgacgacggtcaaggcaacgtactaaagttcgttaccgtttcgggaacgggtacggttaccgagttcgtcgtaccgttcgttcgggccaacggcccgtaaggccctccggccccgtaacggttccgtaacccg

SEQ ID NO: 305733 - DNA, 592 bp, Homo sapiens
  misc_feature: GZ8MTXP01ECX2V.2.35.D02.1.454.CMB.2.raw
  modified_base (447)..(447): a, c, t, g, unknown or other
  misc_feature (447)..(447): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgcccccaaactcctctatttatgaggtcactaagcggccctttaggggtccctgactcgtcttcgtctcggtccctccgaaagtctcggaccaaacgaaccggtccctcccgtcgacccgttctccgtggggccttccaagctaggaggtatgagcttagattatacgnacagtctatagtagtcgacgaggcacgcgaagtacgtaagttacgttacggttcgggaacgggtaacgggacctaggttcgtacggtccgttcgttcgggccaacgacccgtaacgtcccgtcccggttcccctcggttccgtcg

SEQ ID NO: 305734 - DNA, 630 bp, Homo sapiens
  misc_feature: GZ8MTXP01ARU9Q.2.35.D02.1.454.CMB.2.raw
  modified_base (301)..(301): a, c, t, g, unknown or other
  misc_feature (301)..(301): n is a, c, g, or t
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacaacaccccggcgaacgcccccaaactcctctatttangaggtcactaacggcggtcccgttaggggtcccctgactcgtcttctcgtggccctaccagtctggcaacgaccgccctcccgtgacccgtctcgtcgggctcgaagtctggaggntggaggtctagtaatttacttacgtgactagtcccttagtaattagtacgacgtaacgggacacggacaagtacctaagttacggttaccggtttcggggaacgggtaacgggaacctaacggccgttacggtacccggttccggttcgggttaccgaaccggtacccgaacgggtcccgtaccggttcccccgttcggttccccttaacccg

SEQ ID NO: 305735 - DNA, 591 bp, Homo sapiens
  misc_feature: GZ8MTXP01AK5UY.2.35.D02.1.454.CMB.2.raw
  modified_base (248)..(248): a, c, t, g, unknown or other
  misc_feature (248)..(248): n is a, c, g, or t
  modified_base (382)..(382): a, c, t, g, unknown or other
  misc_feature (382)..(382): n is a, c, g, or t
  modified_base (441)..(441): a, c, t, g, unknown or other
  misc_feature (441)..(441): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccggcgaacgcccccaaactcctctatttatgaggtcactaagccggtcccgttagggggtccctgactcgcttctctggccctccagtctggcaacgaaccggcctacccngacccgtctcgtgggcctaccgaagcgtggaggatggacggctagtaattatttaccgngactacgtctacgtatagcgacgacggcacgacgacgtactaagttacgttaccggttcggggaacgggtaacgggaccgacggttcgtcgtacccggttcgttcggaccgaaccgaccgtaacgtcccgtcccggttccctcgcctccg

SEQ ID NO: 305736 - DNA, 750 bp, Homo sapiens
  misc_feature: GZ8MTXP01B8NU0.2.35.D02.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacacccggacgaaccgaccccaaactcctactatttangacgtacacgtaacgcggtacccgttaggggtccctgactcgcttctcgtcggccctaccaagttcgtcggaccgaaacggaacccggtccctcccgtcgtacccgtcgtccgtcggggtcctacccgaacgtcgtacggaggtagtagggacggtacgttaggttaacttttaacgtttaaccgttcgaccgtaacggtccttaaccggtaagtttaacgttacgaccggtaacggacccgtaaggaccgtaacgggtacctaaacggttttaccgggtttaacccggtttttacgggggaaccgggggtaaacggggttaacccggtaaacgggttccgttaaccgggtaaccccggttcccgggttacggggttacccggtaaccggaccccggtaacgggtcccgtccccggttcccccggttaacgggttccctttaaccccg

SEQ ID NO: 305737 - DNA, 703 bp, Homo sapiens
  misc_feature: GZ8MTXP01BDC01.2.35.D02.1.454.CMB.2.raw
  modified_base (312)..(312): a, c, t, g, unknown or other
  misc_feature (312)..(312): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcactggaggcagcagtgacgttggcgttataactatgtctctgtatcaaacaaccgaccccggacgaaccgacccccaaactccctactaatttacnggtacggtaccaacgtaacggccggtacccgttacgggggtccctggacttcgtcttctcgtcggtcccttaccgaagtccgtaggaccaaacgggaacccggtccctcccgtcggtacccgttctcggtcggggacctacccgaaagtcgtaggaacggtagtaggacgggtcttaggtaatttatacgtgacgtagtccttagtaattacgtcgacgtacggcgaaacgcgaaacggtacttaaagtttcggtttacggtttaccgggggaacgggtaacgggaacccgtaaggttccgtacgggtaccccgttcggttacggggaccgaaccgggaccccgtaagggtccccgtcccggttacccccgttcgggttccccttaacccg

SEQ ID NO: 305738 - DNA, 775 bp, Homo sapiens
  misc_feature: GZ8MTXP01CV3S4.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctcgcgtccggtctcctggacagtcagtcaccatctcctgcacgtggagcagcagtgtacgttggacgttaataactgtgtctcgtaggtatacaacaaccgaccccggacgaaaccgacccccctaaactccctataatttacaggtacggtaccaacgtaacggccggtaccccgtttagggggtcccccttaggacttccgtcctttcgtcgtcggtccccttaccgtaagtccgtacggaccgaaaaccgggtaacccgggtccccttccccgtacgggtaaccccgttcgttccggtacgggtcccttaacccgaacgtcgttacggaagggttacgttacgggacgggtactttagggttattttaaacgtttcggtacacgtaacgtaccttagggtaacgttacggttcgaaccggaggacccgtagacgtaaacgtacttaaacggtttcggttttaacccggtttcggggaaaccggggaaccggttaaaccgtaacggttccgttaaccgggtccggttaaccggttcgggttaccaacccggtaccccgaagtcccgtcccggttccccgttaacggttcccttaacccg

SEQ ID NO: 305739 - DNA, 598 bp, Homo sapiens
  misc_feature: GZ8MTXP01BYMPP.2.35.D02.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgagcccagtctgccctgactcagcctccctccgcgtccgggtctcctggacagtcagtcaccatctcctgcactggaggcagcagtgacgttggcgttatactatgtctctgtancaacaccacccggacaacgcccccaaatcctatattangagtcacgtaagccggtccgttaggggtccctagactcgcttctcgtcggcctcagtctggacagaaccgcctccctgaccgtctcgtcgggcctaccgaagcgtaggaggacttaggaggtcttagtaactttatacgtcgactagcgttacagttatacgccgaggcaggacagtactaaagttcgttaacgtttcggggacggttaacgggtaccttaggccgttacggacccgttccggttacgggtaaccgaccggaacccgaacgggtccttccggtcccccgttcggtaacccc

SEQ ID NO: 305740 - DNA, 544 bp, Homo sapiens
  misc_feature: GZ8MTXP01BY3QS.2.35.D02.1.454.CMB.2.raw
  modified_base (405)..(405): a, c, t, g, unknown or other
  misc_feature (405)..(405): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacacccgcgaacgcccccaaactcctcatttatgagtcactaagcggtcccgttacggggtccctgatcgcttctctggccctcagtctggcaacgaaccgcctccctgacccgtctcgtcgggctccgaagctagaggntggaggtctagtattattactgcagtctcgatagtgcagcagcagctaagtgttacgtttcgggaacggtacgggaccaagttcgtacgtacccgttcgttcggcaaccgccaacgggcctccgcccctcggcttcccg

SEQ ID NO: 305741 - DNA, 626 bp, Homo sapiens
  misc_feature: GZ8MTXP01BMWNH.2.35.D02.1.454.CMB.2.raw
  modified_base (434)..(434): a, c, t, g, unknown or other
  misc_feature (434)..(434): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacacccccggcgaaacgccccccaaactcctcatttatgaggtcactaagcggcccttaggggtccctgatcgcttctctggccctccaagtctggcaagaaccggccctccctgacccgtctcgtcgggctccaagctagaggatggaggtctgtatttacttacngtcagcttcaattagtcgacgaggccaggcaaggcctaaagttcggtttaccgttttcggggaacgggtaacggggaacccaaagggttccgtacggtaaccccggttcccggttcgggggttacccaacgggtacccccgaaaggggccccgttcccgggacccccccgttccggggttcccttaaccccg

SEQ ID NO: 305742 - DNA, 527 bp, Homo sapiens
  misc_feature: GZ8MTXP01ELAFH.2.35.D02.1.454.CMB.2.raw
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaaacgcccccaaactcctcatttatgaggtcactaagcggcccttagggggtcccctgatcgcttctctggcctccaagtctggcaagaaccgcctccctgaccgtctcgtgggctccaagctgaggatgaggctgtacttattactgcagctcgatatgacaggcagctagctaatgttacgtttcggcggagggaccaagcgtgaccgttcgttgggttcaagcccaagcctcgcccctggttcctc

SEQ ID NO: 305743 - DNA, 619 bp, Homo sapiens
  misc_feature: GZ8MTXP01B5HRV.2.35.D02.1.454.CMB.2.raw
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacacaccccggcaacgcccccaaactcctcatttangagtcactagcgcccgttagggccctgatcgcttctctcggcctccaagtctggacaaacgaaccgcctccctgacccgttctcgtgggccttaccaagtcgtagaggatgaggtctagtatttacgtactgcagtctacgatagtcgacagggcagacgacgactaaagttcggtttaccgtttcggggaaccggtaacggggaccgaaacgttccgtaacgggtaccccggttccggttacggggttccgaacccggtccccggaaacgggtccccgttacccgggttcccccccgttcggggttaaccctttccccg

SEQ ID NO: 305744 - DNA, 837 bp, Homo sapiens
  misc_feature: GZ8MTXP01CIGA5.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgcacgtggagcagcagtgacgttggcgttaataactntgtctcgtgtatacaacaaccgaccccggacgaaaccgacccccaaactcctactatttatgtacggtacaacgtaacggccggtacccgttacggggtcccctagacttcgtcttcgtcgtcggcccctacctaaggtcgtacggacctaaaccgggaacccggtccccttacccgtacggtacccgttcccgttcggtaccgggggacccttacccgaaaggtcccgtagggtaacgggtagttaaccgggagggtacccgtttaaggttaaactttaacggttttaaccgtacgtacccgtaagtacccttaacggttaaacgttacggtacggaccgtaacgggaccgtaacggacggtaaaccgttaacgttaaacggttttaccgggttttaacccgggtttaaccgggggaacccggggtaaacgggttaaacccggtaaaccggttcccggtttaacccgggttaacccgggtttccggggttaccgggttaacccggtaaccccgggtaaccccggtaacccgggttccccggttaccccgggttacccccggtttaaccggttaaccccgtttcccg

SEQ ID NO: 305745 - DNA, 588 bp, Homo sapiens
  misc_feature: GZ8MTXP01C8AKH.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttaataactatgtctctggtatcaacaacaccccggcgaaacgacccccaaactcctacatttangagtcactaagcgccgttaggggtccctgactcgtcttctctcggccctaccgagtctggaccaagaaccggtccctcccgtcgacccgttctcgtgggcctacccgaagcgtaggaggtagtggaggcttagtatttagtactgctagtcctatatagtgacaggccagcagactaagttcgttaccgtttacgggcggaacgggttacaacgcgttcgaccgttcgttcgggttacaacggtacccgaaggcccgtccggttccccgtcggttaaccgtcccg

SEQ ID NO: 305746 - DNA, 558 bp, Homo sapiens
  misc_feature: GZ8MTXP01ELTYK.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttaataactatgtctctggtatcaacaacaccccggcgaaacgcccccaaactcctcatttatgaggtcactaagcggtacccgttagggggtcccctgatcgtcttctctggccctccaagtctggcaaacgaaccggccctccctgacccgtctcgtggggctccaagctggaggatgaggctgtattatactgcagctcgatagtgacaggcagcaagctaatgttaacgttttcgggcggagggacaacgcgtacgacccgttcgttcgggttcaacgcccgaacggcctccgccccgttaacggttctaacccg

SEQ ID NO: 305747 - DNA, 635 bp, Homo sapiens
  misc_feature: GZ8MTXP01D8SJL.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctcctgcactggagcagcagtgacgttggcgttatactatgtctctgtatacaacaaccacccggacgaacgacccccaaactcctactatttagngacgtcacgtaacggccggtacccgttacggggtccctagacttcgtcttctcgtcggccctaccagtctggacgaaacgaaccggtccctccgtcgacccgttctacggtcgggtacctaccgaagcgtaggaggagtacgaggtctagtattaagttactcgctagtctacgtattagtcgacgaggccagacgtacgactaagttacgtttaccggttcggggaacgggaacgggaaccgtaacggcgttaccggaccggttcggttcgggttaccaaccggtcccgaacgggtccctacccggttccccgttcggttccttccccgg

SEQ ID NO: 305748 - DNA, 564 bp, Homo sapiens
  misc_feature: GZ8MTXP01DG64N.2.35.D02.1.454.CMB.2.raw
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (520)..(520): a, c, t, g, unknown or other
  misc_feature (520)..(520): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggagcagcagtgacgttggcgttaataactatgtctcctggtatcaacaacaccccggcgaaacgcccccaaaactcctcatttatgaggtcactaagcggccttaggggtccctgatcgcttctctcggcctccaagtcgtggctaacggaacgcctacccgtgacccgtctcgtcgggctccagctaggacgatgaggtactgtattatactgcaagctnaatagtgcgagcngtcagctaatgtacgtttgggcggacgggacaaacgttctacggtacccgttcgttcgggttaccncggacccaacgggtccgtccggaccccttcgggttcttaacccg

SEQ ID NO: 305749 - DNA, 722 bp, Homo sapiens
  misc_feature: GZ8MTXP01EV406.2.35.D02.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctctgtatcaacacgacccggacaacgaccccaaactcctctatttangacgtacaacgtaacgccggtacccgtttaggggtcccctggtactcgtccttctcgtcggcccctaccgaagtcgtaggaccaaacggtaacccgggtcccttccccgtaggtaccccgttcgtccgtacgggggcctaccgtaagtctacgggaagtacgtaggacggtcttacggtatttaacgttaacgtcgacgtaacgtcctacggtaattaagtcgacgtacggacgtacgacgtaacggtacgtaaacgtttacgttaccggttttaccggggaacggggttaaaccggggaaccgtaaacgggttccgtaccgggttaaccccggtttccggttcggggttaccgtaacccggtacccggaaaccgggtccccgttcccggttcccccgttaacgggttaacccgttaaccccg

SEQ ID NO: 305750 - DNA, 603 bp, Homo sapiens
  misc_feature: GZ8MTXP01EL8ZS.2.35.D02.1.454.CMB.2.raw
  modified_base (417)..(418): a, c, t, g, unknown or other
  misc_feature (417)..(418): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggacgaaacgcccccaaactcctactatttatggacggtacactaagccggtcccgttagggggtcccctgactcgtcttctctggccctccaagtctggcaaacgaacgcctcctcgaccgtctcgtgggctcaagctgagnngagtctgtattatactgcagctcggattacgtgacgagcagcaagctaagttcgttacgtttcgggaacgggacgggttaacgaaaggttccgtacgggtacccgttaccggttggggttacccaacgggtccccgaaacgggtcccgtaccggttccccccgttcgggttccctttaaccccgg

SEQ ID NO: 305751 - DNA, 547 bp, Homo sapiens
  misc_feature: GZ8MTXP01CN8YA.2.35.D02.1.454.CMB.2.raw
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaaacgcccccaaaactccctacactttatgaggtcactaaagcggtcccttaggggtccctgatcgcttctctggccctcaagtctggcaacgaacggcctccctgaaccgtctcgtgggctcccgaagctgaggntgaggctgattattacngcagtctacgtatatgacgagcagcagactaattcgttacgtttcgggaacggtaacggacacgcgtacgccgttcgttcggacaacgccgaacggtcctccgccccgtcgttcctcg

SEQ ID NO: 305752 - DNA, 698 bp, Homo sapiens
  misc_feature: GZ8MTXP01DQV2N.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatcctctgcactggagcagctagtgtacggttggtagttaataacttatgtcctcgtaggtactacaacaaccgacccggacaaccgacccccaaactcctataatttagagacgtacaacgtaacggccggttacccgttacgggtccctagtacttccgtcttctcgtcgtaccctaccgagtcgtacggaccaaacgggacccgtccctcccgtacggtacccgttccgtcgggtcgggaccttaccgaagtcgtaggtaggagtcggaggtacttagttaattacgtacgtgacacgtcctaggtattacgtacgacgacggaccaagacgtacgtacttaaagtttaccggtttacggtttcgggggaaacggtaacggaaccgtaacgttcgttacccggtaacccggtttcggttcggttaacccgaacggaaccccgtaacggtcccgtccccggttaccccgttcggttaaccccttaacccg

SEQ ID NO: 305753 - DNA, 684 bp, Homo sapiens
  misc_feature: GZ8MTXP01BJIPJ.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttataactatgtctcgtgtatcaacaacaccccggacgaaccgacccccaaactcctacatttancgtaggtcaacgtaacgccggtccccgtttagggggtcccctgtactcgtcctttcgtcgttcggcccctaccgaagttccgtaggacctaaacggaacccggtcccttaccccgtggaccccgttctacggttcggggacccttacgaacgtcgtacggaggtagtggacggtacgtagtaagtttacttacgtgactagctacgtattagtcgacgtacggccgagacgacgacgtaaacgttacgttaccggttttacggggaacgggtaacgggaacccgaacggttaccgtacggtaaccgttacgttacggttccgggtaacgaccgtaacccgaacggtcccgttacccggtccccgttccgggttaacccg

SEQ ID NO: 305754 - DNA, 573 bp, Homo sapiens
  misc_feature: GZ8MTXP01AXL2M.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgcccccaaactcctcatttatgagtcactagcggtcccgttaggggtccctgactcgcttctctggccctcaagtctggccaagaacccggcctacccgtgaccctctcgtcgggctccaagctggaggatggaggtcgtgtatttacttacgttcgacacgtcttacgatagtcgacgacggcacgccgagacgtaagttcgttacgttttcgggaacggaacgggacgaagcgtcgtaccgttcgttcggttacgaacgccgaacgcgtccggttccccgtcggttcctcccg

SEQ ID NO: 305755 - DNA, 691 bp, Homo sapiens
  misc_feature: GZ8MTXP01E103L.2.35.D02.1.454.CMB.2.raw
  modified_base (454)..(454): a, c, t, g, unknown or other
  misc_feature (454)..(454): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggacggttataactatgtctctggtactacaaacaaccaccccggacgaaccgaccccccaaactccctactatttactgtacgtccaacgtaacggtccggtacccgttacggggtccctgactccgtcttctcgtggccctaccgagttcgtggcgaaacggacccggtccctcccgtgtacccgtctcgtcgggcctaccgaagcgtggaacggntggacgtcttaggttatttagttacgtcgactaggtccttacgaatttacgtcgggacgtacgggacaacgaccgaaggaccttaaaggtttcggtttaacggtttaccgggggaacgggtaacgggaaacccgtaaaggttcccgtaccggtacccgggttcggttacggggttccaacgggtaccccgaacgggttccgtaccccggttcccccgttaacggttcccgttccccg

SEQ ID NO: 305756 - DNA, 593 bp, Homo sapiens
  misc_feature: GZ8MTXP01DNAKY.2.35.D02.1.454.CMB.2.raw
  modified_base (246)..(246): a, c, t, g, unknown or other
  misc_feature (246)..(246): n is a, c, g, or t
  modified_base (456)..(456): a, c, t, g, unknown or other
  misc_feature (456)..(456): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctctgcactggagcagcagtgacgttggcgttataactntgtctctgtatcaacaacacccgcgaacgaccccaaactcctactatttatgacgtacaacgtaacgcggtaccgttacgggggtccctagacttcgtctttctcgtcggtccctccaagtcgtcggcaaacgaaccggccctcccgtcgtacccgtctcgtcgggcctaccgaagtcgtaggaggatggaggtcgtagtattagttacngacacgtactacgtagtagtcgacgacgcgagacgaacgtactaagttcgttacgttcgggaacggtaacggacacgttcgtacgtccgttcgttcggacgaacgaccgaacgcctcccgttcccgtcgttccgtcg

SEQ ID NO: 305757 - DNA, 602 bp, Homo sapiens
  misc_feature: GZ8MTXP01EKDDM.2.35.D02.1.454.CMB.2.raw
  modified_base (438)..(438): a, c, t, g, unknown or other
  misc_feature (438)..(438): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatctcctgcactggagcagcagtgacgttggcgttataactatgtctctgtatcaacaacacccgacaacgaccccaaactcctctatttatgaggtcacgtaacgcggtccttagggtccctgactcgtcttctcgtcgcctccagtctggcaacgaaccgccctccgtcgaccgtctcgtcgggtactaccaagtcgtaggaggtagtggagtctagtacttattacgngacagtctacgaattagtagacgaggcacgacgacgactaagttacgttaccgtttcggggaacggtaacggttaccgaaacgttcgtacgtacccgttccggttcgggttaccgaacgacccgaacggtcccgtacccgttccccgtcggttcccgtaacccg

SEQ ID NO: 305758 - DNA, 581 bp, Homo sapiens
  misc_feature: GZ8MTXP01A0LRS.2.35.D02.1.454.CMB.2.raw
tcagacgctcgacacacgaccggtgctcgatttagcacacgatagttaggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttgcgttatactatgtctctggtatcaacaacaccccggacgaacgcccccaaactcctcatttatgagtcactaagcgcccgttaggggtccctgactcgcttctctggccctccgaagtctggccaaggaaccggccctcccgtgacccgtctcgtcggggcctaccaagtcgtaggacggatggaggtctagatttatactgcagctacatagtgcgaggccaggcagactaagttgttacgttttcgggcggaagggacccaaggttcgtacggtacccgttcgttgggttcccaacggcccgtaacgggcctaccggcccccgttaacggttccgttaacccg

SEQ ID NO: 305759 - DNA, 650 bp, Homo sapiens
  misc_feature: GZ8MTXP01ESJDY.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggacgttataactatgtctctgtatacaacaacgaccccggacaacgacccccaaactcctatatttangagtcactaagccggtaccgttacggggtcccctgactccgtcttctcgtcggtccctaccaagtctggcaaacgaaccgccctcccgtgtacccgtctaccgtcggggcctaccgaagtcgtacggaggacgtggaggtcgttagtaattattaacgtcgactaacgtcccttacggaattaagttcggaccgaaggacgaacgcgaaacgtactaagttacggtttacgttttacgggggaacgggtaacggaccgtaaaggttccgttacgacccggttcggttacgggttccgaacggacccgtaacggccgtccggttcccccgtcgggttaacctccccg

SEQ ID NO: 305760 - DNA, 859 bp, Homo sapiens
  misc_feature: GZ8MTXP01C39K2.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttaataactatgtctcctggtatcaacaacgaccccggacgaaaccgacccccaaactccctactatttaactggtacggtaccaacgtaaacggccggtaccccgtttacgggggtccccttggacgttcgtccttcgttcgtcggtccccttaccgtaaacgttcgtacggaccgaaacggtaaacccggtccctacccgtacggtaccccgtttccgtccggtacggggtaccctacccgtaaacggtccgttaaggggtaacgggtaaggttacgggaaacggggtccgtttaacgggttaaatttttaacgtttaaccgttaggtaccgaacgggttaccccgtttaacggtaaatttaacggttacggtaccggtaacggggtaacctaacggtaccgaaacgggtaaccttaaaggttttaccgggtttaaccggttttttcccgggggaacccgggggttaacggggaaacccggtaaacgggttcccgtttaaccggggtacccgggtttaaccccgggttcggggttaaacccggtaacccggaaccccggtaacgggtaccccgtcccgggttccccccggttaacccgggttccccggtttaacccccg

SEQ ID NO: 305761 - DNA, 695 bp, Homo sapiens
  misc_feature: GZ8MTXP01EPFLZ.2.35.D02.1.454.CMB.2.raw
  modified_base (309)..(309): a, c, t, g, unknown or other
  misc_feature (309)..(309): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggacgttataactatgtctcgtgtatacaacaaccgaccccgcgaaaccgacccccaaactcctactatttanggtacgtacaacgtaacggccggtaccgttacggggtccctggactcgtccttctcgtcggccctacctaagtcgtcgacgaacggaacccgcccttcccgtcgacccgttcgtcgtcgggccttaccgaagtcgtaggacgagtggaacgtcgttagttattagttacgtgactagtccttacggtaattagtcgacgacggacgacgactaacgactaaacgtttcggtttaaccggtttcgggggaacgggtaaaccgggaaccgaaggttcccggttaccgggtaacccggtttccgggttcgggttacccgaacccgggaccccggtaacgggtccccggttcccccggttaccccggttccggttcccgtttaaccccgg

SEQ ID NO: 305762 - DNA, 769 bp, Homo sapiens
  misc_feature: GZ8MTXP01D9118.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtgacgttggacgttataactatgtctctgtatacaacaaccaccccggacgaaaccgacccccaaactcctactaatttatacggacggtcaacgtaaacggccggtacccgtttacgggggtcccctggtacttccgtcttctcgtcggtacccctacctaaacgttcgtaggaccgaaacggaacccggtccctcccgtacggtacccgttcgtcgtcggggccttaccgaacgtcgtagggaacggtagtagggacggtacgttaggttaactttacgttaacgtcgacgtacgttaccttaacgtaacgttagtacggacgtaaggggaccaaggacgaaacgtaccgttaaaggtttacggttttaaaccgggttttccgggggaaccgggtaaacggggttaaaccgtaaacgggttccgttaaccgggtaccccgggttaccggttcggggttacccgaacccgggtaacccggtaacgggtccccgttaccccggttcccccggttaaccgggttaacccgtttaaccccg

SEQ ID NO: 305763 - DNA, 623 bp, Homo sapiens
  misc_feature: GZ8MTXP01DHQ9B.2.35.D02.1.454.CMB.2.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttataactntgtctctgtatcaacaacacccggcgaacgcccccaaactcctcatttangaggtcaactaagccggtcccgttaggggtccctgactcgtcttctcgtcggccctccaagtcgtggaccaaacgaacccgtccctccctcgacccgttctccgtcgggctaccgaagcgtaggaggtatggaggtcttagtaatttacgttactcgactagcttacgattagtcgacgaggcaggcaagactaaagttcgttaccgtttcgggaacgggtaacgggacctaacgttccgtacggtaacccggttccgttcggggttaccaaccgggacccgtaacgggtcccgtcccggcccccgttcgggttcccttaaccccg

SEQ ID NO: 305764 - DNA, 636 bp, Homo sapiens
  misc_feature: GZ8MTXP01AMTDI.2.35.D02.1.454.CMB.2.raw
  modified_base (303)..(303): a, c, t, g, unknown or other
  misc_feature (303)..(303): n is a, c, g, or t
  modified_base (504)..(504): a, c, t, g, unknown or other
  misc_feature (504)..(504): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcactggaggcagcagtgacgttggcgttatactatgtctctgtatcaacaacacccggcgaacgacccccaaactcctactatttangacggtacaactaaggccggtcccgttacgggggtccctgtactccgtctttctcgtgccctaccagttcgtgacaaacggaacccgtccctcccgtcgtaccgtctcgtcgggcctaccgaagtcgtagtacggtagtggacggtcgtaggttactttaattacgttacgtcgagtcctagtactagtcgacgacggcgngaccgagacttaacgttcgttaaccggtttcgggaacgggtaacggaccgtaacggccgtacggtaccgttcggttcgggttaccgccggtaccgaacggtcccgtccggttaccccgtcgttcgtaacccg

SEQ ID NO: 305765 - DNA, 674 bp, Homo sapiens
  misc_feature: GZ8MTXP01BGMDZ.2.35.D02.1.454.CMB.2.raw
  modified_base (253)..(253): a, c, t, g, unknown or other
  misc_feature (253)..(253): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatcctcctgcacgtggagcagcagtgacgttggacgttataactntgtctcctgtatacaacaaccgacccggcgaaccgacccccaaactcctactatttatggacgtacaacgtaacgccggtcccgttacgggggtccctgtactcgtccttctcgtcggtccctacctaagtcgtcggaccaaacggaaccggtcccctcccgtacgtacccgtctccgtcggggcctaccgaagtcgtaggaggtagtagacggtacgtagttaatttacgttactacgctaacgtcttacgtaagttacgtacgcgtaacggaccgaggacgtaagtacctaacgtttacggtttacccgtttcggggaaccgggtaacggttaaaccgacgttcgtaccggtcccgttacggttcggttaccaacgtacccgaacgtcccgtccgttccccgtaacgttccgtaacccg

SEQ ID NO: 305766 - DNA, 689 bp, Homo sapiens
  misc_feature: GZ8MTXP01A081B.2.35.D02.1.454.CMB.2.raw
  modified_base (195)..(195): a, c, t, g, unknown or other
  misc_feature (195)..(195): n is a, c, g, or t
  modified_base (478)..(478): a, c, t, g, unknown or other
  misc_feature (478)..(478): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacngtcagtcaccatctcctgcactggagcagcagtgacgttggcgttataactatgtctctggtatcaacaacacccggacaacgcccccaaatcctcatttatgaggtcacgtaacgcggtcccttagggggtccctgactcgcttcgtcgtcgccctcgagtcgtacggctaacggaacccgggtccctcccgtcggtacccgttcgttcgtacgggggtcctacccgtaaagtccgtaggacgggtatcgggaacggtcttaggtaatttacgtttaaccgnggtaccaacggtcccttaacgtaacgttacgtacgacgacggtcgtacgacgtaacgtacgtaaacggtttacggtttaccgggtttaccggggaacgggtaacgggaaccgtaacggttccgtaccgggttaacccggttcggttccgggttaccgaaccggtacccgtaacggtcccgtacccgttccccggttcggttcccttaaccg

SEQ ID NO: 305767 - DNA, 719 bp, Homo sapiens
  misc_feature: GZ8MTXP01DJ7G9.2.35.D02.1.454.CMB.2.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcacgtggagcagcagtgacgttggngttaataactntgtctctgtatacaacaacaccccggacgaaccgacccccaaactcctactatttangacgtacaacgtaacggccggtacccgttaggggtccctgacttcgtcttctcgtcggtccctaccgtaagtcgtcggaccaaaacgggtaacccggcccttcccgtacggtaccccgttctcgtcgggtacctaccgaacgtcgtaggacggtagtcgggtacggtacgttagtaatttaacttaacgtcgaacgtacgaccttaacggtaagttaacgtcggaccgaagggacaacggactaacggtaacgttaaccggtttaggttttaaccggtttacgggggaaccgggtaaacgggaaaccggtaacggttaccgtaccggtaacccggttcgggttaccgggttaccgaacccggtaacccggaacggtcccgtccccgttccccggttcgttccgttaaccccg

SEQ ID NO: 305768 - DNA, 691 bp, Homo sapiens
  misc_feature: GZ8MTXP01C1UIA.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggacgttaataactatgtctctggtatacaacaaccgaccccggacgaaaccgacccccaaaactcctactaatttataggacggttacaacgtaacgccggtcccgtttaacgggggtccctagactcgtcttctcgtcggccctaccgaagtcgtggaccaaacggaaccggtcctacccgtagtacccgttcgtccgtcgggcttacccgaagtcgtaggaaggtatggaacggtcttagtatttaacttacgcgactacgtactacgtatagtacgacgacgacgacgacgacgtacgtaacgttacggtttaccggtttacgggtaacgggtaacgggaaccggtaacggttaccggtaccggtacccggttaccggttcggttaccggtaaccggtacccggtaaccggtacccggtcccggttaccccggttcccggttcccgtaacccg

SEQ ID NO: 305769 - DNA, 695 bp, Homo sapiens
  misc_feature: GZ8MTXP01DKNG0.2.35.D02.1.454.CMB.2.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgcacgtggagcagcagtgacgttggcgttataactntgtctctgtatcaacaacaccccgcgaacgcccccaaactcctanatttangaggtcaactaagcggtcccgttagggtccctgacttcgctttcgctggcccctaccgaagtccgtggaccaaaggacccgtccctccccgtaggtaccccgttcgtccggtcggggtaccttacccgaaacgtccgttagggaacgggtagtacgggtagggtaccgttaggttaaactttaacgtttaacgttcggactaacggtcccttacgtaattaacgttcgaccgaaggggccaaggaccaaggaccttaaagttacggtttaccgttttcggggaacgggtaacggggaaaccgtaaagcgttaccgggtaaccgttccggttcggggttaccaacgggacccgaacgggtcccgtacccggttccccgttcgggttcctaacccgg

SEQ ID NO: 305770 - DNA, 836 bp, Homo sapiens
  misc_feature: GZ8MTXP01CW0AB.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagcctccctccgccgtccgggtctcctggacagtcagtcaccatcctctgcacgtggagcagcagtgacgttggcgttaatactatgtctctgtatcaacaaccacccggcgaacgccccaaactcctactatttangagtcacgtaacgccggtccccgttagggggtcccctgacttccgtacctttcgtcgtcgggtccccttacccgaaagttccgtagggaccctaaaacgggtaacccgggtccccttaccccgttacgggtacccccggtttctcccggtacgggggtccctaaccgtaacggtaccgttacgggaagggtacggttagggaacgggtaccgtttaggtaaatttttaaacgtttaaccgttcgaccgtaacgttacccgttaccgtaaagtttaacgttaaccgggccgtaaacggggtccgtaacggtaccgaacggtaccgtaaaacgttttacgggtttaacccggttttttaccgggggaaccggggtaaaccggggttaaacccgtaaacgggttacccggtaaccgggttaaccccggttcccgggtttccggggttacccgaaccgggtacccccggtaaaccgggttccccggtaccccgggttacccccccggtttcccgggttaaccccgtttaacccccgg

SEQ ID NO: 305771 - DNA, 579 bp, Homo sapiens
  misc_feature: GZ8MTXP01DDHRI.2.35.D02.1.454.CMB.2.raw
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (538)..(538): a, c, t, g, unknown or other
  misc_feature (538)..(538): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctgtatcaacaacaccccggacaacgccccaaactcctnatttangagtcactaagcgcctagggtccctgactcgcttcnctcggccctaccagtctggcaaacggaaccgtcctcccgtgacccgtctcgtcgggctaccaagtctaggaggatggaacggtcttaggtactttattacgcgctacgctacgtaatagtgacgaggcagcaagtctaaagttcggttacgtttcggggaacggtaagggttaccaagcgtacgccggttaccgttgggttaccncggaccccgaaggtcctccggttcccctcggttctaacccg

SEQ ID NO: 305772 - DNA, 649 bp, Homo sapiens
  misc_feature: GZ8MTXP01ALY1Y.2.35.D02.1.454.CMB.2.raw
  modified_base (196)..(196): a, c, t, g, unknown or other
  misc_feature (196)..(196): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctctgcactggagcagcagtgacgttggcgttataactatgtctctggtatacaacaacgaccccggacgaaccgacccccaaactcctactatttatgacgtcaactaacggccggtcccgtttagggggtccctgactcgtcttctcgtggccctacctagtcgtggacaaacggaaccgtccctccctcgacccgtcgtccgtcggggcctaccgaagtcgtaggaggtacgtgggacggtctaggtaatttacttacgtgacacgtcttactaagtagtcgaccgagggccaggaccaaggtactaagttcgtttacggtttcggggaacggtaacgggaccgtaaacggttccgtacggtacccggttccggttcgggttaccgaaccggcccgtaacggtcccgtacccgttccccgtcggttcccgttaacccg

SEQ ID NO: 305773 - DNA, 707 bp, Homo sapiens
  misc_feature: GZ8MTXP01D0XNN.2.35.D02.1.454.CMB.2.raw
  modified_base (311)..(311): a, c, t, g, unknown or other
  misc_feature (311)..(311): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatacaacaaccaccccggacgaaaccgaccccccaaactccctactactttancgacgtacaacgtaaacgcggtacccgtttacgggggtcccttgacttccgtccttctcgtcggtcccctaccgtaagtcgtcggacaaaaccgggaacccggtccctccccgtcggaccccgttcgtccggtcggggcctaccgaacgtcgtaggaaggtagtaggacgggtacttaggttaactttaacttaccgttgacctaacgtccttacggtaagttaacgtggaccgaagggcacggaccgaggtacctaagttacggtttaccggttttacggggaacgggttaacggggaccctaaacggttccgttacgggtaacccgttccggttcgggttaccgaaccggaccgaacggttcccgcccggttaccccgttcggttcctttcccg

SEQ ID NO: 305774 - DNA, 669 bp, Homo sapiens
  misc_feature: GZ8MTXP01DQQUO.2.35.D02.1.454.CMB.2.raw
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggnaaacgcccccaaatcctnatttangagtcacgtagcggtccttagggtccctgatcgtcttctcgtcgcctccaagtctggcaaacgaaccgtcctacccgtcgtaccgtcgtccgtgggctaccgaacgtcgtaggacgggtatggacggtcttacggtaatttagttaacgtgacagtctacggaattatgacgagacgaggctaacggactaaagtttcggtttaaccgtttttcggggaacggggtaacgggttaacccgtaaacggttccgttaaccggtccccgggtttaaccggttcggggtttacccgaacccggttaccccgggaaacgggtccccgttccgggttaacccccccgtttccggggttaacccgtttcccccggg

SEQ ID NO: 305775 - DNA, 713 bp, Homo sapiens
  misc_feature: GZ8MTXP01BO1X7.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttaataactntgtctctgtatacaacacgacccggacaaaccgacccctaaactcctactatttagtacgacgtacaacgtaacggccggtacccgttacgggggtcccctagacgttccgtcttctcgtcggtccctccgtaagtcgtggaccaaacgaacccgtccctcccgtcgtacccgtcgtcgtcgggtacctaccgaagtcgtaggacggtagtaggacggtacgttagttaacgtttacgttaacgtcgtactaacggtcctacggtaattacgtacgaccggaggaccgaacgacgtaacgtacgttaacgtttacggttttaccgggttttaccgggggaacggggttaaacgggacccggtaaacggttccggttaccgggtacccggttccgggttacgggttaccgaaccggacccgaacggtcccgtcccggttaccccgttcggttcccgttaacccg

SEQ ID NO: 305776 - DNA, 607 bp, Homo sapiens
  misc_feature: GZ8MTXP01D8GVB.2.35.D02.1.454.CMB.2.raw
  modified_base (251)..(251): a, c, t, g, unknown or other
  misc_feature (251)..(251): n is a, c, g, or t
tcagacgctcgacacacgaccggtgctcgatttagcacacgatagttgggtttgggggtctcaggaggcagcgctctcaggacgtcaccaccatgacctgggctctgctcctcctcaccctcctcactcagggcacagggtcctgggcccagtctgccctgactcagccctccctccgcgtccgggtctcctggacagtcagtcaccatctcctgcacgtggagcagcagtgacgttggacgttataactntgtctctgtatcaacacaccccgacgaacgaccccaaactcctactatttatgacgtcacgtaagccggtccgttacggggtccctggacttccgtctttctcgtcggccctaccgaagtcgtggaccaaacgggaacccggcccttcccgtacgtacccgttctcggtcgggtcctacgaagcgtaggaggtagtggagtactagtaactttatacgcgactagtcctacgtaatgtgacgaggcagcaagtactaaagttcggtttaacgttcggggaacggtaacgggacgacgcgtacgacgttccggttgttacgcgaccgaacgtccaccgttccccgtcgttcgtcccg

SEQ ID NO: 305777 - DNA, 655 bp, Homo sapiens
  misc_feature: GZ8MTXP01AEPKY.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaaccaccccggcgaacgcccccaaactcctcatttangagtcactaagcggtcccgttaggggtccctgactcgcttctctggccctccagtctgggcaaacgaacccgggccctaccccgtggacccgttctccgttcggggcctacccgaaagccgttaggacgggtaatcggaaggtcctagtaatttacttaaccgtgactacgtctcgaattagtcgacgagggaccaggaccaaggactaaagttcgttaaccggttttcggggaacgggtaaacggggttacccaaacggttcgttaaccggtacccgtttccggttcgggttacccgaacgccccgtaacgggcccgtacccggttcccccttccgggttccttaaccccg

SEQ ID NO: 305778 - DNA, 658 bp, Homo sapiens
  misc_feature: GZ8MTXP01CPYO8.2.35.D02.1.454.CMB.2.raw
  modified_base (249)..(249): a, c, t, g, unknown or other
  misc_feature (249)..(249): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctctggtatcaacaacaccccggacgaacgacccccaaactcctactatttatgaggtacactaagcggtacccgttagggggtccctgacttcgcttctctggccctaccgaagtcgtggccaaacgaaccggccctcccgtacgacccgttctcgtcggggctaccgaagtcgtaggaggagttggacgggtcttaggtactttagttaacctgacaagtctacgtaattagtgaccgaagggcaacggcaaggcctaaagttcggtttaacgttttcgggggaacggtaacgggaccctaaaggttccttaacgggtacccgttccggttgggggttaccctaacgggaccccgtaacgggtcccttccggttccccccgttaacgggttccctttaaccccg

SEQ ID NO: 305779 - DNA, 685 bp, Homo sapiens
  misc_feature: GZ8MTXP01C9MKG.2.35.D02.1.454.CMB.2.raw
  modified_base (310)..(310): a, c, t, g, unknown or other
  misc_feature (310)..(310): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctctgcacgtggagcagcagtgtacggttggacgttataactatgtctctggtatcaaacaaccgaccccgacgaacgacccccaaactcctctatttangtacgtacacgtaacgccggtaccgttacggggtccctgacttcgtcttctcgtcggtcccctaccgtaagtcgtacggaccgaaaaccgggtaacccgtccccttcccgtccggtaacccgttccgtccggtcggggtcctacccgaaacgtcgttacggacgggtagtacgggtaaacgggtctttaggtaacttttaacgtttacgtcggactaacgtctacgtaattacgtgaccgaggacacgcgtaagacttaagttgttacggtttcgggaacggtaacggactaaggttcgtaccggtaccgttcgttcgggttacgaacgtacccgaacggtccgtcccgttccccgttaacggttccttaacccg

SEQ ID NO: 305780 - DNA, 573 bp, Homo sapiens
  misc_feature: GZ8MTXP01CE9D9.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggacgaacgcccccaaactcctacatttatgaggtcactaagcggtcccttagggggtccctgactcgtcttctctggcccctccaagtctggcaaacggaacccggcctccctgacccgttctcgtcggggctccaagctgaggatgaggtctagtattatactgacagctacgatagtgacgaggcagcacgactaaagtcgttacgtttcgggaacggacgggttacaacgcgtacggacccgttcgttcggttccaacgcccgtaacggccctccggcccccgtcggttcctaacccg

SEQ ID NO: 305781 - DNA, 639 bp, Homo sapiens
  misc_feature: GZ8MTXP01BA67R.2.35.D02.1.454.CMB.2.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntctcctgcacgtggagcagcagtgacgttggcgttanaactatgtctctggtatcaacacaccccgacaacgaccccaaactcctctatttangacgtacactaagccggtaccgttagggtccctgacgtctcttctctggccctcgagtcgnggtacaacgaaccggtcctcccgtcgtacccgtcgtcgtacgggcctacgagctaggagctggaggcgttagtatttatacgtcgacagtactctaattagcgtcgaacggacgacgacgtaacggtacttaacgttaccggtttacggttttacgggggaaccgggtaacggggaccctaaacgggttccgtaacgggtaccccgttcgttcgggggttaccaaccggaccccgtaacgggtcccgtcccgcccccggttcggttccgttaaccccg

SEQ ID NO: 305782 - DNA, 858 bp, Homo sapiens
  misc_feature: GZ8MTXP01DASQB.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatcctctgcacgtggagcagcagtgacggttggtacgttaataactatgtctcgtgtactaccaaaccaaccgaccccggacgaaaccacccccaaacttcctacttaatttagtacggtaacgtacctaaacgtaaacggtccccgggttaccccggtttaaccgggggttcccctaggtaaccgtttccggtaccctttttccgtccggttaccgggtaccccccttaacccggtaaaggtttcccggtacggaacccgggaaaaaacccggttaaacccccggggttccccctttaaccccggtcgggtttaaacccccggttccgtttacgggttccggggaccccttaaccccgaaaggtccgttaaggggaaaccggtaggttagggaacggtaccgttaagtttaagttttaaccgttaattcgtaacggtaaccgtacttaacggtaagttacgtacggacgtacggaccgtaacggacgtaaacgtaaccgtttaaggtttaccggtttaccgggttaaccggggaacgggtaaacggaaccgtaacggttaccgtaccgggtacccggttcggttccggacccgaaccggacccgtaaccgtcccgtccccgttaccccgttaaccgttcccgttaaccg

SEQ ID NO: 305783 - DNA, 788 bp, Homo sapiens
  misc_feature: GZ8MTXP01A3RMY.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacacccggacgaacgcccccaaactcctctatttatgacggtacactaaggccggtacccgttagggggtcccctgactccgtccttctcgtcggtcccctaccgtaagttccgtacgggaccaaaacggaaacccgtaaccccttccccgtacggtaccccgttccgtccggttcggggtaccttacccgaaagtccgttagggaacgggtagttagggaggtaccgttaggttaaattttaacgtttaacgttacgggacctaacggtcccttaacgtaaacgtttaagtacgggtaaccgaaggggtacccaaagggtacccaaagggtacccttaaaaggtttccggttttaaccgggtttttaccgggggaaccgggggtaaaccggggaaaccgtaaacggttccggttaccggtaaccccggttccgggttacggggttacccgaacccgggtaccccggtaaaccgggtcccgttacccggttccccccggttaaccgggttaacccttaaccccg

SEQ ID NO: 305784 - DNA, 605 bp, Homo sapiens
  misc_feature: GZ8MTXP01EQBIS.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgccgtccgggtctcctggacagtcagtcaccatctcctgcactggaggcagcagtgacgttggcgttataactatgtctctggtatcaacaaccaccccggcgaaacgcccccaaactcctctatttangaggtcaactagcggtacccgttagggggtccctgtactcgtcttctcgtggccctcaagtctggcaacgaacgcctcccgtgaccgtctcgtcgggctaccgaagtctaggaggatggaggtctagtattacttactgacacgccttaggattagtgcgaacggcaggcagactaagttcgttacgtttcggggaacggtaacgggttaccaaacggttcgtacggtcccgttaccggttgggttaccgaacggtacccgtaacggccgttcccggcccccgttcgggttcctaacccg

SEQ ID NO: 305785 - DNA, 625 bp, Homo sapiens
  misc_feature: GZ8MTXP01A75QS.2.35.D02.1.454.CMB.2.raw
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgatatactatgtctctgtancaacaaccgacccggcgaaccgcccccaaactcctataatttagngaggtccaacgtaagccggtcccgttacgggtccctagtactcgcttcgtcgtcggacctacgaagttccgaggaccacggaaccggtccctacccgtcgacccgtctcgtcgggcctaccgaagtcgtggacgatgagtctagtattactagtgactagcgtactagtactgacaggccagacacggtactaagtttacgttccggtttaacgggacgggttaacgggtaaccaaaggtcccgtaacggttacccggttcggttacgggttaaccacggtaaccccgtaacggcccggttccgtcccccgttaagtccccg

SEQ ID NO: 305786 - DNA, 552 bp, Homo sapiens
  misc_feature: GZ8MTXP01BQREL.2.35.D02.1.454.CMB.2.raw
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaaacgcccccaaaactcctcatttatgaggtcactaagcgccttaggggtccctgatcgcttctctggcctcaagtctgcaacgaacggcctccctgacctctcgtggggctaccgaagctaggagagtgaaggctgattattacngcanctagatatgacgaggcagacagtactaagttcgttacgttcgggaacgggacggaacgaacgcgtacggaccgttcgttcggttacgaaccgaccgaacggcctcccgccccgtcgttccgtccg

SEQ ID NO: 305787 - DNA, 577 bp, Homo sapiens
  misc_feature: GZ8MTXP01A8FGG.2.35.D02.1.454.CMB.2.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtgacgttggcgttataactatgtctctgtatcaacaacacccggcaacgcccccaaactcctcatttagngaggtcaactaagccggtccttagggggtccctgactcgctttcncgtggccctcaagtctggcaagaccgctcccgtgacccgttctcgtgggctccgagtctggagatggaggctagtattagttactcgtcagtctcggtatagtcgacgaggcaacgcgagtaccgtaagttcgttaccggtttcgggaacgggttaacgggaccgtaaacgttccgtcgacccggttcgttgggttccaacgccgaacggctccggcccctcggttcctccg

SEQ ID NO: 305788 - DNA, 801 bp, Homo sapiens
  misc_feature: GZ8MTXP01DABRT.2.35.D02.1.454.CMB.2.raw
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcnctgcactggagcagcagtgacgttggcgttanaactatgtctctggtatcgaacaacgaccccggacgaaacgaccccctaaaactcctactatttaagtgtacggtacaaccgtaaacggccggtccccgttaagggggtccccttagacttccggtctttcgtcgttcggacccttccgaaacgttcgtacggggaccaacggaaacccgggtcccctacccgtcggtaaccccgttcgtccgtcggggtacccttacccgaaaggtccgtaaggtaacggggatttacggggaaaggtccgtttaaggtaactttttaatttaaccggtacgtacgtaacgtccgttaactaaacggttacgtaccggacggtaacgaccgtaacggacgtaaacggtacgtttaacggtttaccggtttaaccggggttacggggtaaacgggaaccggttaaaccggtaccggttaaccggttacccgggtaccggtttacccgggttcggttaacccggtaaccccgggtaaccggttaacccgggtaccccgtccccggttacccccgggtttccgttaaccccgtttaacccg

SEQ ID NO: 305789 - DNA, 612 bp, Homo sapiens
  misc_feature: GZ8MTXP01C5HPZ.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttataactatgtctctgtatcaacaacaccccggacgaaacgcccccaaactcctactatttangaggtacacgtaagccggtcccgttaggggtccctgactcgtcttctcgtcggccctaccaagtcgtggcaaacgaaccggccctccctcgacccgttctcgtcgggcctaccgaagtcgtggaggagtggaggtcttagtatttacttacgtgctaagtcctacgtatagtgacgaggcacgcaagctaaagttcggttacgtttcgggaacgggaacgggttaaccaacggttcgtacggtcccgttcggttcgggttaccgaaccggacccgaacggcccgtccgccccgttcggttccttaacccg

SEQ ID NO: 305790 - DNA, 719 bp, Homo sapiens
  misc_feature: GZ8MTXP01AUKN3.2.35.D02.1.454.CMB.2.raw
  modified_base (313)..(313): a, c, t, g, unknown or other
  misc_feature (313)..(313): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgccctccctccgcgtccgggtctcctggacagtcagtccaccatcctcctgcactggagcagcagtgacgttggacgttataactatgtctcgtgtatacaacaaccgaccccggacgaaccgacccccaaactcctactatttancgacgtacaacgtaacggcccggtacccgttagggggtccctgtacttcgtccttctcgtcggcccctaccgtaagtcgtacgggacctaaacgggaacccggtcccttacccgtacggtaccccgttccgtcggtccggggcctacccgaacgtccgtaggaaggtagtcgggtaggtacgttagttaatttacttacgtcgactacgtcctacgtaagttagtacggaccgaggcacgacgtaacggacttaaaggttcgttaccggtttacggggaacgggtaaacgggttaaccgtaaacggttcccgtaccggtaacccggttccgggttcgggttacccgaaccggacccggtaacggtccccgtccccggttcccccgtaacggttcccttaaccccgg

SEQ ID NO: 305791 - DNA, 590 bp, Homo sapiens
  misc_feature: GZ8MTXP01EV7S9.2.35.D02.1.454.CMB.2.raw
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaaacaacaccccggacaaacgccccccaaaactccctcaatttatgagtcactaagcgtccgttaggggtccctgatcgcttctctggcctccaagtctggcaagaacggccctccctgacccgtctcgtgggcttcgaagctgaggactgaggctgtattattacngcagtctacatagtgacgagcgacgacaacgtactaaagttcgttaccggtttcgggaacggtaacgggaaccgtaacgttccgtacggtacccgttccggttcggttacgaaccggtacccgtaacggtcccgtcccgttccccgtccggttccgtccg

SEQ ID NO: 305792 - DNA, 774 bp, Homo sapiens
  misc_feature: GZ8MTXP01BH4OW.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggacgaacgaccccaaactcctactatttatgacggtcacgtaacggcgtcccgttacgggggtccctgtactcgtcttcgtctcggccctacgaagtcgtacggacaacggtaaccgggtccctcccgtcgtacccgttccgtccgtcgggtcctaccgaacgtcgtacggtagggagttacgggacggtaccgttaggttaaacttttaacgtttaccgtacgtaccgtaaacgttccgttaccgttaagtttacggttaccgaccggtaacgggacgtaacggaccgtaaacggtaacgtaaaacgttttcgggtttaacccgggtttttacccggggggaacgggttaaaccgggggaaaccccgtaaaggggttcccgttaacccgggtaaccccggtttcccgggttacggggttacccgaacccggggaaccccgtaaccgggttaccccgtaccccggttcccccccgttaacgggggttccccgttaacccccggg

SEQ ID NO: 305793 - DNA, 646 bp, Homo sapiens
  misc_feature: GZ8MTXP01BWD0L.2.35.D02.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaaccacccggcgaacgccccaaactcctctatttangagtcactaagcggtacccgttagggggtccctgactcgtcttctcgtcggtccctaccgaagtcgtaggccaaacggaaccggtccctcccgtcggtacccgttcgtaccgtcggggtctaccgaaacgtcgtaggacggagtcggaggtcttaggtacttagttacgtgctagtcctgtaacttagcgtacgaggcacggactaacggtctaaacgttggttaccgttttcggggaacgggtaacggggacctaaaggcgtaccggtacccggttcgttcggggttccaacgggaccccgtaacggtcccgtacccggccccgttaacggttcccgttaacccg

SEQ ID NO: 305794 - DNA, 516 bp, Homo sapiens
  misc_feature: GZ8MTXP01BWNWN.2.35.D02.1.454.CMB.2.raw
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaacgcccccaaactcctcatttatgagtcactaagcggccccttaggggtcccctgatcgcttctctggcctccaagtctggcaagaacggcctccctgacccgtctctgggctccagctgaggatgaggctgtattacgtaactgctagctcatatgcaggcagcagctaatcgtacttgggcgtagggccaaggctgacttccgttggttcngcaaggctcncccctcgttcgtaac

SEQ ID NO: 305795 - DNA, 629 bp, Homo sapiens
  misc_feature: GZ8MTXP01B54H5.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaaccaccccggcgaacgaccccccaaaactcctactatttatgacggtcaactaacgccggtacccgtttagggggtcccctgacttccgctttctcgtcggccctccgaagtcgtacggcaaacgaaccggtccctccctcggacccgttctaccgtcggggcctacccgaacgtccgttaggacggagtggaacgggccttaggtactttaattaacgtgacagtacctataattagtcgcgaggcagacagactaagttcgttaacgttttcgggaacggtaacggaccgaacgttcgtacgtacccgttcggttcggcgtaaccgccgaacggtcgtaccggccccgtcgttccgttccg

SEQ ID NO: 305796 - DNA, 686 bp, Homo sapiens
  misc_feature: GZ8MTXP01DNRMM.2.35.D02.1.454.CMB.2.raw
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
  modified_base (400)..(400): a, c, t, g, unknown or other
  misc_feature (400)..(400): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccgacaacgccccaaactcctcatttangagtcactaagcgccgttagggtccctgatcgcttctntcgcctccaagtctggcaacgaacgcctccctgacccgtctctggggctccgaagtctgacggntcggaaggctaggtatttacgtactcgcgaacgtcctacattagtacgccgaagggccaaggtcaaacggtcctaaaagtttccggttaccgtttttaccgggggaaccggggttaaaacggggaccccgtaaacgggttaccgttcccggggtaacccccgttttcccggggttcgggggttaaccccgtaaccgggtaaccccccgggaaaaccggggttccccgggttaccccgggttacccccccccgggttccgggggttttcccccgtttaacccccggg

SEQ ID NO: 305797 - DNA, 772 bp, Homo sapiens
  misc_feature: GZ8MTXP01CPS1K.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcacgtggagcagcagtgtacggttggcgttaataactatgtctcctggtactacaacaaccaccccggacgaaccgaccccctaaactccctactatttagtagacgtcaacgtaacggccggtacccgtttacggggtccctagacgtcgtcttctcgtcggtccctaccgaagtcgtacggctaaacggaaccggtccctcccgtcggacccgttctcggtcgggacctacccgaagtcgtagggacggtagtagggaacggtcgttaaggttactttaacgttaaccgttgaccgtaaacgtccgttaacgtaacgttacgttaccgggaccggttaacggggaacccaaggaaccgtaacgtaaacgttaaacggttttacggttttaaacccgggttttcccggggggaacggggtaaaccgggttaacccgtaaaccgggttccgttaacccggggtaacccggttccggggtttacgggccctaaccgggaaccccgtaacgggtccccggttaccccgggttcccccgttccggggttaacctttcccccgg

SEQ ID NO: 305798 - DNA, 779 bp, Homo sapiens
  misc_feature: GZ8MTXP01AMRGP.2.35.D02.1.454.CMB.2.raw
  modified_base (259)..(259): a, c, t, g, unknown or other
  misc_feature (259)..(259): n is a, c, g, or t
tcagacgctcgacacacgaccggtgctcgatttagcacacgatagttgggtttgggggtctcaggaggcagcgctctcaggacgtcaccaccatggcctgggctctgctcctcctccaccctcctcactcagggcacagggtcctgggcccagtctgccctgactcacgccctccctccgcgtccgggtctcctggacagtcagtcaccatcctcctgcacgtggaggcagcagtgtacggttggacgttaataacttntcgtcttcgtaggtactaccaaacaaccgaccccggacgaaaccgacccccctaaacttccctactaatttacgtacgtaacggttacaaccgttaaacggcccgggttaccccggtttaacgggggtccccttaggacgttccgtccttttccgtccgttacgggtcccctacccgtaagttccgtcgggacctaaacgggaacccggtccctccctaccgggtacccgttcgtccggtcggggacccttacccgaaagtcgttacggaaggtaacgtcggacggttaccgtagtaactttaacgttaacgcgtaccgtaacgttccttacggtaagttacggttcgaccggaacggtcgaacgtccgaagtaccgtaaagtttcgggtttaacggtttccggggaacgggtaaccgggttaacgtaaacgttccggtaccgggtacccgttcgggttcgggaccgtaaccggacccgtaacggtccgtacccgccccgttaaccggccgtttaacccg

SEQ ID NO: 305799 - DNA, 712 bp, Homo sapiens
  misc_feature: GZ8MTXP01BM0IT.2.35.D02.1.454.CMB.2.raw
  modified_base (250)..(250): a, c, t, g, unknown or other
  misc_feature (250)..(250): n is a, c, g, or t
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcacgtggagcagcagtgacgttggcgttataactntgtctcgtgtatcaacaaccaccccggacaacgaccccaaactcctatatttangacgtacaactaacgcggtcccgttagggtccctgactcgtcttctcgtcggccctaccgaagtcgtacggaccaaacggtaacccgtccctcccgtcggtacccgttccgtcgtcgggtcctaccgaagctaggagagtggaaggtcttagtaatttactacgtacgccgtaagtcctacgtaagttacgtcgaccgaagggacctaagaccgaaaggtaccctaaagggttttacggtttaaacccgggttttccgggggaaccggggtaaaccggggaaccgttaaaccgggcccgtttaccgggtaaccccgtttccggggttacgggttaccccgaaccgggttaccccggaacgggtccccgtacccgggttcccccccgttaacgggttcccttaaccccg

SEQ ID NO: 305800 - DNA, 621 bp, Homo sapiens
  misc_feature: GZ8MTXP01DBQTI.2.35.D02.1.454.CMB.2.raw
  modified_base (294)..(294): a, c, t, g, unknown or other
  misc_feature (294)..(294): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccgcgaaacgcccccaaactcctnatttatgaggtcactaacgcgacccgttagggtcccctagactcgtcttctctcggcctccaagtctggacaacgaaccggcctccctgacccgtctccgtcggggctaccgaagctagtaggattggaggtactgtattattacgtgaccagtcctgattaagtgaccgaggaccgagacgagacctaaagttcgttaacgttttcggggaacggtaacgggaccgtaaaggcgtacggtaaccccggttcggttcgggttacccaacgggaaccccgtaacgggtcccgtacccgttccccccggttcgggttccgttaaccccg

SEQ ID NO: 305801 - DNA, 649 bp, Homo sapiens
  misc_feature: GZ8MTXP01BD33E.2.35.D02.1.454.CMB.2.raw
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagtttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcaatgacgttggcgttataactatgtctctgtatcaacaacacccgcgaaacgccccaaactcctnatttangagtcactagcgtccgttacggggtccctgactcgtctttcgcgtgcccctaccagtcgtaggccaaacggaaccggccctcccgtagtacccgtctcgtcggggcctacccgagtcgtaggaggagtggaggtcgttagtaatttacttaacgtcgtacgacgtcctacgtattaagttcgacggacggacgaacgcgaacgtacgttaaacgtttacgtttaacggtttttccgggaacggggtaacgggttaccgtaaacgttcgtaccggtacccgttcggttcgggttaccgaaccggacccgtaacggtccgtcccggttccccgttcgggttcccgttaacccg

SEQ ID NO: 305802 - DNA, 621 bp, Homo sapiens
  misc_feature: GZ8MTXP01CFQ01.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggagcagcagtgacgttggcgttaataactatgtctctggtatcaaacaaccgacccggacgaaaccgaccccctaaactccctactatttatgacgtacaacgtaacgccggtaccgttacgggtccctgactccgtcttctctggtcccctaccgaagttcgtcggacaacggacccgtccctacccgtcggacccgttctcgtcgggcctaccgaacgcgtaggaggacgtgaggtcttagtatttactacgtgctagtctactagtagtgacgagccagcaagactaagttcggttaacgtttcgggaacgggtacggaccgtaagccgtaacggtcccgttacggttcggttacaacggaccgaacgtccgtcccgttcccgtcgttccgttaacccg

SEQ ID NO: 305803 - DNA, 569 bp, Homo sapiens
  misc_feature: GZ8MTXP01EPOOH.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggacgaaacgccccccaaaactcctacaatttatgacggtacactaaagccggtcccttagggggtcccctgactccgtcttctctcggccctaccaagtctggcctaagaaccggcctccctgacccgtctctgggcttccgaagctgagatgagctgtattagtactgacagctgaattatcgcaggcagcagctaatgttactttcgggcggtagggaccaaggccgtaggacccgttccgttggggttccaacggccccgaaggcctcggccccctcgggttcctaacccg

SEQ ID NO: 305804 - DNA, 658 bp, Homo sapiens
  misc_feature: GZ8MTXP01AHXTZ.2.35.D02.1.454.CMB.2.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtcaccatctctgcacgtggagcagcagtgacgttggcgttatactntgtctctgtatacaacacacccggcaacgaccccaaactcctactatttangacgtcacgtacgccggtaccgttacggggtccctagacttccgtctttcctcgtcggtcccctacgtacgtcgtacggacaaaccgggtaacccgtccctacccgtcggtacccgttccgtcggtcgggacctaccgagcgtaggagtagtaggaggtctagtatttacgtacgtgacgtagtcctagtagtacgtcggacgacggacgagacacgacttaacgttacggttacggtttacgggaacgggtaacgggaaccgtacggttccggtaccggtacccgttcggttcgggccgaaccggtacccggaaccggtcccgtaccccggttacccgtaacggttccgttaacccg

SEQ ID NO: 305805 - DNA, 732 bp, Homo sapiens
  misc_feature: GZ8MTXP01DNXEW.2.35.D02.1.454.CMB.2.raw
  modified_base (685)..(685): a, c, t, g, unknown or other
  misc_feature (685)..(685): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcgtgtactacaacaaccgacccggacgaaccgaccccctaaacttcctactaatttacgtagtacgtactaacgtaacggccggtacccgtttacgggggtccctagtacgttcgtcctttctcgtccgtcccctaccgtaagttccgtcggaaccgtaaacggtaaccccggtcccttacccgtacgggtaccccgttcgtccggttacggggtcctaacccgtaagtcgttagggaggtaacgtcgggacgttacgttaggtttaaatttaacgtttacgcgtactaacgtccgttaacgttaacttaggtccgaacgaacggggtcctaacgggacctaaacgtacgttaaagttttaccggttaccggtttacggggaacgggtaacgggaaacgtacgttcggtaccgtaccgttcggttcggaccnccggaccgaaccggtcctccccgccccggttcgttaacccgttcccg

SEQ ID NO: 305806 - DNA, 800 bp, Homo sapiens
  misc_feature: GZ8MTXP01CR5P1.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtggtacgttggacggttaataactatgtctctggtatacaacaaccgaccccggacgaaaccgaccccccaaaactcccttactaatttacgtaggtaacggttaccaaccgtaaacgggcccgggtaccccgtttacgggggtccccttaggacttccggtcctttccgtcgtcggtaccccctaccgtaaacgttcgtacggaccgtaaacgggtaacccggtcccttacccgtaccggtacccgttcgtccggtacggggtaccctacccgtaaacggtccgtagggacggtagtcggaacgggtcttaacggttatttaacgtttacgtacggactacggtcttacggtaagtttacgttacggacgaacggcgaacgtacgaacggtaccttagggttacggtttaccgggtttacgggggaaccgggtaaaccggggttaaaccgtaaacggttccgttaaacccgggtcccgggttaccggttacggggttacccgaaccgggaaccccggtaacggtcccggttaccccgttcccccggttccggttaaccccgtttccccg

SEQ ID NO: 305807 - DNA, 765 bp, Homo sapiens
  misc_feature: GZ8MTXP01A5LJO.2.35.D02.1.454.CMB.2.raw
  modified_base (306)..(306): a, c, t, g, unknown or other
  misc_feature (306)..(306): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctctgcacgtggagcagcagtggacgttggacgttataactatgtctctgtatacaacaaccgacccgacgaaccgaccccaaactcctactatttagnggtacgtacacgtaacggccggtaccgttacgggggtcccctgtacttccgtctttcgtccgttcggtccccttaccgtaaacggttccgtacggacccgaaaaccgggtaaccccggtccccgttccccgtacgggtaccccgttcgttccggtacggggtaccttacccgaaacgtcggtacggaggtacgtcggtaaggtaccgtttagtaacgttttaacgtacgttgaccgtaacgtccttaacgggtaattaaccgtaggacgtacgggtacacgtaccggaacgtaaccgttaaaggttacggttttaaaccggtttcgggggaaacgggttaacgggaacccgtaaacggttccgttaaccgggtacccgttacgggttcgggttacccgaaccgtacccgaacgggttcccgtacccggttcccccggttaacggttcccgttaaccccg

SEQ ID NO: 305808 - DNA, 639 bp, Homo sapiens
  misc_feature: GZ8MTXP01EWFIN.2.35.D02.1.454.CMB.2.raw
  modified_base (304)..(304): a, c, t, g, unknown or other
  misc_feature (304)..(304): n is a, c, g, or t
  modified_base (513)..(513): a, c, t, g, unknown or other
  misc_feature (513)..(513): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttataactatgtctctgtatcaacaacacccggacgaaacgacccccaaactcctctaatttangagtcactaacggccggtcccgtttacggggtcccctgacttccgctttccgtcgtcggtacccctacctaaagtcgtacggaccgtaaaacgaacccggtcccttacccgtcggtaccccgttcgttccgtacggggcccttacccgaaacgtcgtacggaggtacgtgacggtactagttaagtttacttacgtcacgacgtcctanagttaacgcgacgagcgagagaacgtagtagttacgtttaccggttgggaacggtaacggaccgacgttcgtacgtaccgttcgcggaccaacgtaccgaacgcctccgttcccgtcgttcctccg

SEQ ID NO: 305809 - DNA, 603 bp, Homo sapiens
  misc_feature: GZ8MTXP01AEYS1.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaaccaccccggcgaacgacccccaaactcctacatttangagtcaactaagccggtcccgttagggggtccctgatcgcttctctggccctccagtctggcaagaaccggcctcccgtgaccgtctcgtcgggctaccgagctgaggatgagctagtattattactgcagctcgatatgacgaggcagcacgactaagttcggttaccgttttcggggaacgggtaacgggttaccgtaacggttcgtaccggtaacccggttcccggttcgggttaccgaaccggtacccgaacggtcccgtcccggttcccccgttccgggttcccttaacccgg

SEQ ID NO: 305810 - DNA, 724 bp, Homo sapiens
  misc_feature: GZ8MTXP01DK01B.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacaacacccggcgaacgcccccaaactcctcatttatgagtcactaacgcggcccttaggggtccctgatcgtcttctctcggtccctccgtaagtcgtcggacaaacgaaccggtccctccctcgtacccgttctcgtcgggtcctaccaagtctcggaggacgtggaacggttctaggttaactttaacgttacgtcgactaacgtccttacgtaagttaacgttcgacccggtaagggcccgaaggaccgtaaacgtacgttaaacgtttcggtttaaacccgggtttttcgggggaacccggggtaaacggggttaaccccgtaaacgggttccgttaaccgggggtaccccggtttacccggggttcggggttaacccgtaacccgggaccccggtaaacggggttccccgtaccccggttacccccccggttcggggtttaaccccgttaaccccg

SEQ ID NO: 305811 - DNA, 787 bp, Homo sapiens
  misc_feature: GZ8MTXP01B93DI.2.35.D02.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaaccacccggcgaacgacccccaaactcctactatttangtacgtacactaacggccggtacccgttaggggtcccctgacttccgtctttctcgtcggtacccctccgtaagtcgtcggacctaaacgggaacccggtccccttccccgtacggtaccccgtttcctccggtcggggtccctacccgaacggtccgttagggaacgggtagttagggagggttaccgttaggttaaactttttaacgttaaccttgggacctaacgggtcccgtttaaccgtaagtttaacggttaccggaccggaaacggggccctaacgggaccgtaaacggtaccttaaaaggtttcgggttttaacccggttttacgggggaacccggggtaacgggttaaacccgtaaacggttccggttacccgggtaacccggttccggtttccggggaccgtaacccgggaaccccggtaaccgggttccccgttccccgggttaccccccgtttccggttcccgtttaaccccg

SEQ ID NO: 305812 - DNA, 714 bp, Homo sapiens
  misc_feature: GZ8MTXP01AUFXQ.2.35.D02.1.454.CMB.2.raw
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcacgtggagcagcagtgacgttggcgttataactatgtctctgtatcaacaacacccgganaacgaccccaaatcctatattangagtacacgtagccggtccgtaggggtccctgactcgcttctcgtgcccctcgagtcgtgcaacgaccgcctccctcgaccgtctcgtcgggcctaccgaagtcgtaggacggtagtcggagggtacttaggttaactttacgttaacgtcggtactacgtaccttactaagttacgtacggaccggaacggtacgaacggtacgtaacggtaaacgttaaacggttttaccggtttaaccgggttttaccgggggaaccggggtaaacggggttaaacccggtaaacggttcccgggttaccgggtaaccccggttccgggttacggggttaccgtaacccgggtaaccccggtaacgggttccccggtaccccggttccccccgttaaccgggtttaaccctttaacccccgg

SEQ ID NO: 305813 - DNA, 684 bp, Homo sapiens
  misc_feature: GZ8MTXP01AJIUI.2.35.D02.1.454.CMB.2.raw
  modified_base (387)..(387): a, c, t, g, unknown or other
  misc_feature (387)..(387): n is a, c, g, or t
  modified_base (497)..(497): a, c, t, g, unknown or other
  misc_feature (497)..(497): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtggacggttggtcggttaataacttatgttcctccgttggtaactaccaaaccaaaccgacccccgggacgaaaccgacccccctaaacctccctactatttatggacggtccaacgtaacggccgggtcccgttagggtcccctgactcgtcttcnctcggccctcgagtcgtgacaacgacccgcctccgtgaccgttcgtcgtcgggcctaccgagcgtaggaggtatggagtactagtatttacgttcacggtcagtccttanattaaggcgacgacgggcacgtacaacgtactaacggtttcggtttaccggtttcgggggaacggggttaaacgggaacctaaacgggttccgtaccggtaacccggttccgggttcggggaccctaaccgggccccgtaacgggtcccctcccgggttcccccgttcgggttcctttaacccccgg

SEQ ID NO: 305814 - DNA, 644 bp, Homo sapiens
  misc_feature: GZ8MTXP01DVEGS.2.35.D02.1.454.CMB.2.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcacgtggagcagnagtgacgttggcgttatactatgtctctgtatcaacacacccgacgaacgacccccaaactcctactatttangtacgtacacgtaacgccggtacccgtttacggggtcccctggacttcgtccttcctcgtcggtcccctaccgaagtcgtggacgaaccgaacggtccctacccgtcgtacccgtctccgtcgggtctaccagtcgtaggacggtagttggaggtcttaggttaacttttacgtttacgcgcgtaactcttactaagttacgtcgcgaagggccaggaccaagtaccgtaagtttcggtttaccggtttaccgggaacgggtaacggacgtaacgccgtcgtaccgttcgttcgggaccgtaaccgacccgaaggtcccgtccgttcccgtccggttctttcccg

SEQ ID NO: 305815 - DNA, 586 bp, Homo sapiens
  misc_feature: GZ8MTXP01BQB3P.2.35.D02.1.454.CMB.2.raw
  modified_base (342)..(342): a, c, t, g, unknown or other
  misc_feature (342)..(342): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcgaacgcccccaaactcctactatttatgagtcactaagcggtcccgttagggtccctgactcgcttcnctcgcctccagtctggcaacgaccgcctcccgtgacccgtctcgtcgggctaccagctggaggactggaggtctagtatttagtacgtgctagtcctacgtattagtcgacgaggccaggcaagtctaaagttcgttacggtttcgggcggtaacgggaccaaggttccgtacggtacccgttcggttcgggttaccaacggcccgaacggtccctccggttcccccgtcggttcctaaccccg

SEQ ID NO: 305816 - DNA, 683 bp, Homo sapiens
  misc_feature: GZ8MTXP01ASHG6.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtgacgttggcgttataactatgtctcctggtatcaacaacgaccccggacaacgacccccaaactcctactatttatgtaggtcaacgtaacggcggtacccgttagggggtcccctgagttccgcttctcgtcggccctaccaagtcgtcggacaaacgaaccggccctcccgtacgacccgtctccgtcgggcctacccgagccgtaggaggtacgtgacggcgttagtaatttacttaccgtagccgtagtcctacgtaattagtcgacgaggaccacgtacgaacggtactaaggttcgtttaccggtttacggggaacgggtaaccgggttaaccgaacgggttccgttaccgggtacccggttcccggtttcggggaccgaacccgggtaccccgtaaacgggtccccgtacccggaccccccggtttcgggttaacccttcccccg

SEQ ID NO: 305817 - DNA, 675 bp, Homo sapiens
  misc_feature: GZ8MTXP01EKATY.2.35.D02.1.454.CMB.2.raw
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatacaacaacaccccggacgaaacgcccccaaactcctacatttangagtcaactaagcggtcccgtttagggggtcccctgactcgtcttcgtctcggccctccaagtcgtggccgaaacgaaccggtccctcccgtcgacccgtctcgtcggggctacccgaagcgtaggaggataggaggtacgttaggttaactttaacgttacgttacgacgtacgtaccttaccgtaattagttacggaccgaagggccaaggcgaaacggtaccttaaaagttcgtttaacggttttaccggggaacgggtaacgggaccgtaaacggttcgtaccggtaaccggttccggttacgggggttccaacgggacccgtaacgggtccccgtccggcccccgttcgggttaacccttccccg

SEQ ID NO: 305818 - DNA, 613 bp, Homo sapiens
  misc_feature: GZ8MTXP01D2NJ5.2.35.D02.1.454.CMB.2.raw
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagtcgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccgcaaacgcccccaaactcctcatttangaggtcactaagcgtcccgttaggggtcccctgatcgcttctcgtcggcctccaagtctggcaaacgaccgcctaccctgacccgtctcgtcgggctaccaagctgagatgaggctgtattactacgtcgactagctacgtaattacgtacgacgaaggccaaggaccaaaggtacctaaagttccggtttaaacgtttttcggggaacgggtaacgggaacccaaaggttccgtaacggtcccgttaaccgttcggggttaccaaccggacccgaacggtcctaccggcccccgttcgggttccttaaccccg

SEQ ID NO: 305819 - DNA, 643 bp, Homo sapiens
  misc_feature: GZ8MTXP01C0R4Y.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctgtatcaacaacacccggcgaaacgcccccaaactcctactatttangacggtcactaacgcggtcccttaggggtccctgactcgtcttactcgtggccctaccgagtcgtggcaaacggaaccggcctcccgtgtacccgtctcgtcggggctaccgaagtctaggacggtattgggacggcttaggtatttacgtactgacctagcctcggtaatagtcgacgaggcgagcgtaacggtctaaacgttcgtttaaccggtttcgggaacgggtaacggggttaacccaaacgggttcgtaacggtacccggttccggttcggggttaccaacggtaccccgtaagggtccctacccggttcccccgttaaggttccccttaaccg

SEQ ID NO: 305820 - DNA, 608 bp, Homo sapiens
  misc_feature: GZ8MTXP01BA8K9.2.35.D02.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacaccccggcgaacgcccccaaactcctctatttanggaggtcaactaaggccggtacccgttagggggtccctgactcgtcttctcgtcggccctccgaagtctggccaaacgaaccgggccctcccgtcgacccgtctcgtcggggccttaccgaacgtctaggacggtataggaggtacgtagtattacgttactgcagctcaatagtgacaggccagcagctaagttcgttaccgtttcggggaacggtaacgggaccgtaaggcgtacggtaacccgttccgttcggggttccaacggacccgtaacggtccgtcccgaccccgtcggttcctaacccg

SEQ ID NO: 305821 - DNA, 764 bp, Homo sapiens
  misc_feature: GZ8MTXP01CTYAD.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttgcgttataactatgtctccgtgtactacaacaacgaccccggacgaaccgaccccctaaaactccctactaatttatcggtaacggtcaaacgttaacggccggtaccccgttacggggtacccctggaacttccgtctttctcgtcggtccccttaccctaaagtcgtcgggacaaacgggaaacccgtcccttccccgtacgggacccgttccgtcgtcggggtccacccgtaaacgccgtacggacgggaagtcgggaacggtacgttacggtaacttttaagttaaccttgaccgtaaggtcccgtttaaacggtaacgttaacggttacggaaccggacggtaccgaacggaacgtaacgtaacgtaaacgtttacggtttaaccgggtttaacggggaaccgggtaacggaacccggtaaacgttccgtacggtaaccccgttccggttacggttacccgtaacccggtacccgtaacggtcccgtcccggttacccccgttaacggttaacccgttaaccg

SEQ ID NO: 305822 - DNA, 745 bp, Homo sapiens
  misc_feature: GZ8MTXP01ATNGQ.2.35.D02.1.454.CMB.2.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtaaccatctcctncactggagcagcgagtgacggttggtcggttaataacttatgtctcctggtatacaacaaccgaccccggacgaaccgacccccaactcctctatttanagagtcaactaacggccggtaccgttacggggtccctagacgttcgtcttcttcgtcggtcctacccctaacggcgttcggaccgacggtaaaacccggtcccttccccgtcgacccggttctccggtcggggccttacccgaagtccgtaggtaagggtagtagggtaacggccgtttaaaggtaacttttaacgttaaccgtcggacccgtaagttccttaacgtagttacgtacggggaacccgtaaggggaccctaagggactaacggaccgttaagttacggtttaccggtttacggggacgggaaacgggtacccgttaagccccgttacggtaacccgggtccggttcggaccgaaccgggtaaccccgaacggggtcccccttcccgggtcccccggttccgttaacccgttccccgtttccgg

SEQ ID NO: 305823 - DNA, 664 bp, Homo sapiens
  misc_feature: GZ8MTXP01BWYR5.2.35.D02.1.454.CMB.2.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttataactntgtctctgtatacaacaacacccggacgaacgaccccaaactcctactatttangagtcactaacgcgtcccgttagggtccctgactcgtcttctcgtcggccctaccaagtctggacaaacgaccgtccctcccgtgacccgtctcgtcgggtcctaccaagtctacggaggtacgtggacggtacttagtaactttacgttaacgtcgtactacgtccttacgtaattacgttacggacgaagggccaaggacaacgggtactaaaggtttcggtttaaccggttttcggggaacggggtaacgggttaaccgtaacggttccgtaccgggtacccggttccgttcggggttacccgtaacggaccccgtaacggggtccctcccggttccccgtcgggttcccttaacccg

SEQ ID NO: 305824 - DNA, 634 bp, Homo sapiens
  misc_feature: GZ8MTXP01DAYDW.2.35.D02.1.454.CMB.2.raw
  modified_base (307)..(307): a, c, t, g, unknown or other
  misc_feature (307)..(307): n is a, c, g, or t
  modified_base (428)..(428): a, c, t, g, unknown or other
  misc_feature (428)..(428): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaggcagcagtgacgttggcgttataactatgtctctggtatacaacaacaccccggacgaaacgcccccaaactcctctaatttangagtcaactacgcggtccctttaggggtccctgactcgtcttctcgtcggcctaccaagtctggaccaacggaaccggccctacctcgacccgttctcgtcgggctaccaagctaggaggngtgaagggtctagtatttactacgtcgactacgtcctcgtaaatgtcgaccgaaggcgacgcgtaaacggtcctaaagttcgttaaacggtttccggggaacggtaacggggactaaacgccgttacggcccggttcccgttggggttacccaacgggtacccgaagggtccctcccggttcccccgtaacggttccttaacccgg

SEQ ID NO: 305825 - DNA, 571 bp, Homo sapiens
  misc_feature: GZ8MTXP01EP1OT.2.35.D02.1.454.CMB.2.raw
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (454)..(454): a, c, t, g, unknown or other
  misc_feature (454)..(454): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatctcctgcacgtggagcagcagtgacgttggcgttaataactatgtctctgtatcaacaacaccccggacgaacgacccccaaactcctactatttangagtcactaagcggtccttagggtccctgatcgcttcncgtgccctcaagtctgactaaacggaaccgtccctcccgtgtacccgtctcgtgggctaccaagcgtgaggatggaggtctagtattagtactgactagctacgattacngacgagcacgcagtactagttcgttacggttcgggaacggtaacggacgacgcgtacgtccggttcgttcggttacgcgtaccgaacggtccgtcccgttccccgtcgttccgtccg

SEQ ID NO: 305826 - DNA, 651 bp, Homo sapiens
  misc_feature: GZ8MTXP01DZ6Y4.2.35.D02.1.454.CMB.2.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
tcagacgctcgacacacgaccggtgctcgatttagcacacgatagttgggtttgggggtctcaggaggcagcgctctcaggacgtcaccaccatggcctgggctctactcctcctcaccctcctcactcagggcacagggtcctgggcccagtctgccctgactcagcctccctcgcgtccggtctccgtggacagtcagtcaccntctctgcagtggagcagcagtgacgttggcgttanactntcgtctcgtgtatcaacaaccaccccggacgaaccgaccccctaaactcctactatttatgacggtcaacgtaacggccggtaccgtttacgggggtccctgtactcgtacttctcgtggtcctaccgacggtcgtcggcaacggaaacccggtccctccgtacgtacccgttcctcggtacgggtcctaccgaagtcctaggaggtactcgggaagtcttaaggttactttaacgttacgacggctaacggcttaaccgtattaacgcggacgacggacaacggcagtacgttaagttcgtttaaccgttcggacgggaacgtaacgagtcgttacgtaccggtcgttacggttcacggtaaccgtacgccgtcccgtacccgttcgtcccgttaacgttccccg

SEQ ID NO: 305827 - DNA, 701 bp, Homo sapiens
  misc_feature: GZ8MTXP01ALMU3.2.35.D02.1.454.CMB.2.raw
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggaggcagcagtgacgttggcgttatactatgtctccggtatcaacacaccccggcgaacgcccccaaactcctactatttangacggtccaacgttaacggccggtaccccgtttagggggtcccctgactccggtctttcctcgtcggtcctaccccgaagttcgtcggacaacggaaacccgggtcccttcccgtgaaccccggttcctccgtggggacccttaccgaaaggccgttaggagggacgttacgggaacgggtccgttaggtaacgttttacgttaacgtcggtcctaaggtccttaccgtaacttagttcggaccgtacgggacgacgacgaacggtacctaaagttccggtttaaccggttttcgggacggggtaacggaaccgaagtccgacggttacccggtccgttcgggttaccgaccgaacccgaacggtccttaccggccccgttacggtcccttaacgttccccg

SEQ ID NO: 305828 - DNA, 798 bp, Homo sapiens
  misc_feature: GZ8MTXP01ENC1I.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatacaaacaaaccgacccccggacgaaaccgccccctaaactcctactatttatgacggtcaactaaggccggtcccgttacgggggtccccttaggactcgtcctttcgtcgtcggccccttaccgaaaggttcgtacgggaccaaaacgggtaacccgggtccccttccccgtacgggtaccccgtttccgtccggttccgggggacctttaccccggaaagggttcccgttagggaacgggtaacgttgggaacgggtaccgttaggttaaagtttttacttaaccgttcgggactaacggtacccgtttactaaacgttagttaccgaggtaacggggaccctaagggacccaaaggggtaccttaaaaggttccggttttaaccggttttccgggggaacggttaacgggggaaaccgtaaacggttccgtaacgggtaaccccgtttcgggttcgggggttaccccgaacggacccccggtaacggtcccgtaccccgggttcccccggttccgggttaaccctttccccgg

SEQ ID NO: 305829 - DNA, 784 bp, Homo sapiens
  misc_feature: GZ8MTXP01CKTSW.2.35.D02.1.454.CMB.2.raw
  modified_base (256)..(256): a, c, t, g, unknown or other
  misc_feature (256)..(256): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctcgccctgactcagccctcctccgcgtccgggtctcgtggacagtcagtcaccatcctctgcacgtggagcagcaggtgtacggttggacgttaataactntgtctcgtagtactacaaaccaaccgacccggacgaaaccgaccccaaactccctactatttagcgtacgtacaacgtaacggccggtacccgttacggggtccctaggtacttccgtcttcgtcgtcggtacccctaccgtaagtcgtacggaccaaaccggtaacccggtccccttaccgtccggacccgttccgtccggtcggggtaccctaccgaaacgttcgtacgggaagggtagtaacggggtacgttacgttaggtttaaactttaacggtttacgacgtaccaacgttcccttaacgttaattaacggtcgaccggtaagggaccaacggtacaaacggtaccgttaaaggtttaccggttttaccggtttaaccgggggaacggggtaaaccgggttaaaccgaacggttccgggttaccggtacccgggtttacccgggttcggggttacccaaccgggtaacccgttaaccgggccccgttcccggacccccgtttccggttccccgttaaccccg

SEQ ID NO: 305830 - DNA, 571 bp, Homo sapiens
  misc_feature: GZ8MTXP01E1WFY.2.35.D02.1.454.CMB.2.raw
  modified_base (429)..(429): a, c, t, g, unknown or other
  misc_feature (429)..(429): n is a, c, g, or t
  modified_base (545)..(545): a, c, t, g, unknown or other
  misc_feature (545)..(545): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacacccccggcgaaacgccccccaaactcctcatttatgaggtcactaacgcggccccttacggggtccctgatcgcttctctggcctccagtctggcaagaaccggcctccctgaccgtctctggggctccgaagcgtgaggatgaggctagattattacngtcgagctcgatagtgcaggcagccagctaaattgtaccgttttcggggcggtaacgggaccaaaggcgtacggaacccgttccgttcggggttccaacgggcccaaacgggtccncggccccccgtcggttccctaacccg

SEQ ID NO: 305831 - DNA, 689 bp, Homo sapiens
  misc_feature: GZ8MTXP01DSYNQ.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcaggcacaggtcctgggcccagtctgccctgactcagccctccctccgccgtccgggtctccctggacagtcagtccaccatcctcctgcactggagcagcagtgacgttggcgttataactatgtctctggtatcaacaaccgaccccgacgaaaccgccccaaactcctactatttatagaggtacaacgtaacgccggtaccccgttagggggtccccttaggtacttccgtcctttcgtccgtcggtccccttacccgtaagtccgtcgggtaccaaaccgggtaacccggtccccttcccgtccgggtaccccgttccgttcggtcggggccttaccgaacggtcgtagggagtacgttggaggttacttagttaattacgttaccgtgtactagtaccttcgtaattagtcgacgagccgaggacaagaccgtaagttcggtttaccgtttacggggaacggtaacgggaaccgaacggttcgtaccggtaaccgttccgttcggttaccgaaccgacccgaacggtcccgtcccgccccgtccggttctccccg

SEQ ID NO: 305832 - DNA, 629 bp, Homo sapiens
  misc_feature: GZ8MTXP01A3BO0.2.35.D02.1.454.CMB.2.raw
  modified_base (300)..(300): a, c, t, g, unknown or other
  misc_feature (300)..(300): n is a, c, g, or t
  modified_base (453)..(453): a, c, t, g, unknown or other
  misc_feature (453)..(453): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacgaccccggcgacgcccccaaactcctcatttangaggtcacgtaagcggtccttaggggtccctgactcgtcttctcgtcggccctccaagtctcggaccaacggaaccggcctcccgtgacccgtctcgtcggggctacgaagcgtagaggatggaggtcgtagtacttatacgtgcagtcctanattagtcgacgaggacagcgaagactaaacgttcggtttaaccggtttcggggaacgggttaacgggaacccgaaacggttccgtaccgggtacccgttacccggttcggggacccgaacggtccccggaaacggtcccgtcccggttacccccggttcgttaacccgttaacccg

SEQ ID NO: 305833 - DNA, 696 bp, Homo sapiens
  misc_feature: GZ8MTXP01DEO2Q.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtgacgttggcgttataactatgtctctggtatacaacaaccgaccccggacgaaacgaccccccaaactcctactaatttatgtagtacaacgtaacgccggtacccgtttagggggtccctgacttcgtctttctcgtcggcccctaccgtaagttccgtacggaccgaaacggtaacccgggtccccttccccgtacggtaccccgttcgttccggtcggggtcctacccgaagtcgtaggaggtacgtggaggtactaggttactttattacgtgactagtcttacgtaattagtcgacgtacgggacagacgaacgtacctaaggttcgttacggtttccggggaacgggtaaacggaccgtaaacggccgttaacggaccccggttcggttcgggaccgtaaccggacccgtaacggtcccgtcccggttacccccggtttcggttaacccttaaccccgg

SEQ ID NO: 305834 - DNA, 760 bp, Homo sapiens
  misc_feature: GZ8MTXP01A1TSI.2.35.D02.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttatactntgtctctgtatcaacaacncccggcgaacgccccaaactcctactattangagtcactaacgcggtccttagggtcccngtactcgtcttctctaggccctacctaacgtcgtcggaccgaaacggaacccggtccctcccgtaccgtacccggtctccgtacgggccttacccgaacggtccgtaggagggtaactggacggggtaccttaggtaatttaacgttaccgttacgaccgtaacgttccttacgggtaattacggttacgacccgtaacggggtacccaaggtaccgaaacgtacccgttaaaggtttcccgggtttaaaccgggttttccgggggaaccggggttaaacgggggaaccgtaaaccgggttccgtaaccggggtaacccccggtttacccggggttcggggttacccggtaacccggggaccccggtaaaccgggtttcccccggtaccccgggttacccccccggttcggggttcccccgtttaaccccggg

SEQ ID NO: 305835 - DNA, 688 bp, Homo sapiens
  misc_feature: GZ8MTXP01BAP99.2.35.D02.1.454.CMB.2.raw
  modified_base (249)..(249): a, c, t, g, unknown or other
  misc_feature (249)..(249): n is a, c, g, or t
  modified_base (314)..(314): a, c, t, g, unknown or other
  misc_feature (314)..(314): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcacgcctcctccgcgtccggtctcctggacagtcagtcacatctcctgcacgtggagcagcagtgacgttggacgttataactntgtctcgtgtactacaaacaaccgaccccggacgaaaccgacccctaaactcctactatttacgngacgtcaacgtaacggccggtaccgttaggggtccctgtactcgtcttctcgtcgccctaccgtaagtcgtgacctaaacgaaccgtccctccgtacggacccgttctacgtcgggacctacgtaacgtcgtaggacggtagtacggacggtacgttagttaatttaacgttacgtcgactacgtaccttacgtaacgttagtacgacgaacggcgaacggactaaacgtaccgttaaagttaccggtttaacggtttccgggaacgggtaaacggttaccgtaaacggttcgtaccggtaccggttacggttcggaccgtaacgggacccgtaacggtcccgtacccgttccccgttcgttaacccgttcccg

SEQ ID NO: 305836 - DNA, 687 bp, Homo sapiens
  misc_feature: GZ8MTXP01CW95C.2.35.D02.1.454.CMB.2.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctcgcgtccgggtctcctggacagtcagtcaccatctctgcactggagcagcagtgacgttggcgttanaacgtatgtctctgtatcaacaacaccccgngaaacgccccaaactctcatttangagtcataagcggcccttaggggtcccngactcgcttctcgtcggtccttcgaaagtcgtgacgaacgaaacgggtccctaccgtgtaacccggtctccgttcggggaccttacccaaacggtcttacggaaacggacgttagaacgggtcgttacggtaacgttaagttaacctttaggtacctaaggacccgttacgtaacgttaaactttggtaccgaggacccgacggaaacgtaacgtaacgtaacgttacgttaccggtttacgggtaacgggtaacgggttaaccggtaacgttacgtaccggtaccggttaccggttcggttaccggtaaccgtaccggtaaccggtaccgtacccggttaccccgttcccggttccgtaaccg

SEQ ID NO: 305837 - DNA, 614 bp, Homo sapiens
  misc_feature: GZ8MTXP01CL1A6.2.35.D02.1.454.CMB.2.raw
  modified_base (394)..(394): a, c, t, g, unknown or other
  misc_feature (394)..(394): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgcccccaaactccctcatttatgaggtcacgtaagcggtcccgttaggggtcccctgactcgcttctctggccctaccgagtctgacaagaaccggccctcctgacccgtctcgngggctaccgaagcgtggaggatggaggcttagtatttacttacgtgactagtctactattagtgaccgaggccagacgacgtacctaagttcgttaccgttttcggggaaccggtaagggacccgtaaggccgttacggacccgttccggttcggggttaccaaccgggtacccgtaacggtcccgttacccggcccccgttcgggttcccttaaccccg

SEQ ID NO: 305838 - DNA, 640 bp, Homo sapiens
  misc_feature: GZ8MTXP01DBAIM.2.35.D02.1.454.CMB.2.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcnctgcactggagcagcagtgacgttggngttataactatgtctctgtatcaacaacacccgacgaacgaccccaaactcctctatttangagtcactaacgcggtaccgtaggggtccctgactcgtcttctctcggtccctaccgaagtcgtcggacaaacggaaccggtccctccctcggtacccgttctccgtcggggtcctaccgaagtcgtaggaggagttacggaagggtcttaggtaatttacgttacgtcgacgtaagtccttacgtaacttagtacggccgaaggccaagacgaacgtacctaagtttacggttacgtttcgggaacgggtaacggaaccgacgttcgtacgggtacccgttcgttcggttaccgaacgtacccgaacggtccctaccggttccccgtcggttccgtaaccg

SEQ ID NO: 305839 - DNA, 602 bp, Homo sapiens
  misc_feature: GZ8MTXP01A6PUW.2.35.D02.1.454.CMB.2.raw
  modified_base (248)..(248): a, c, t, g, unknown or other
  misc_feature (248)..(248): n is a, c, g, or t
  modified_base (406)..(406): a, c, t, g, unknown or other
  misc_feature (406)..(406): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacaccccggcgaacgcccccaaactcctctatttatgagtcactaagcggcccttaggggtccctgactcgtcttctctggccctccaagtctggccaacgaaccggccctcccgtgacccgtctcgtgggctcagctgagntgagctagtattattactgacagtctacgtatagtcgacgaggccagcgaacggtactaagttacggtttaaccgtttcggggaacgggaacgggaacctaaacggccgttacggtaaccccggttcggttcgggttaccgaaccggtcccgaacggtcccgtcccgttaccccccgttcgggttcccttaacccg

SEQ ID NO: 305840 - DNA, 586 bp, Homo sapiens
  misc_feature: GZ8MTXP01BRT35.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaacgacccccaaactcctcatttatgaggtcactaagcggcccgttaggggtcccctgactcgcttctctggccctaccaagtctggcaaacgaaccggccctccctgacccgtctcgtgggctccgaagctggaggatggagctgtattattactcgcagtctcgaatatgccgagcaggcaagtctaaagttcggttaccgtttcgggaacgggtaacgggaccaaagttccgtacggtacccggttccgttcgggacgccggtacccgaacggcctcccggccccgtccgggttccgttaacccg

SEQ ID NO: 305841 - DNA, 637 bp, Homo sapiens
  misc_feature: GZ8MTXP01DTSWJ.2.35.D02.1.454.CMB.2.raw
  modified_base (307)..(307): a, c, t, g, unknown or other
  misc_feature (307)..(307): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttaataactatgtctctggtatacaacaaccaccccggacgaacgacccccaaactcctactatttangagtcacgtaagcggtacccgttagggtccctgactcgtcttctcgtggccctaccgtagtcgtggaccaaacggaacccggtccctacccgtacggtacccgttctccggtcggggctacccgaagtcgtaggacgggtatggaacgtcgttagtaatttagttacgagcaagtctacgtaattagtcgacgaaggcgagaccgagactaaagttcggttaccgtttgggaacggtaacggacgaacgttcgtacggtccgttacggttcgggaccaacggacccgtaacggtcccgtcccggttccccgttccggttccttaaccccg

SEQ ID NO: 305842 - DNA, 652 bp, Homo sapiens
  misc_feature: GZ8MTXP01EFD3Q.2.35.D02.1.454.CMB.2.raw
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttataactatgtctctggtatcaacaacacccgcgaacgccccaaactcctcattangagtcactaagcggtccttagggtccctagtactcgtcttctctcggtccctccgaagtcgtagaccgaaacgggaaacccgcccttcccgtcggtaaccccgttcgtccgtggggaccttacccgaaaggtccgtaggaagggtagtagggtaggtccgttagtaattttacgtagttcgaccagtctacggtaattagtgcgaacggacagtaccgagtaccgtaaagttcggttaacgtttcggggaacgggtaacgggacctaaaggttccgtacgggtacccgttccggttgggttaccaacggtacccgaacgggtcccgtccggttcccccgttccgttccgttaacccg

SEQ ID NO: 305843 - DNA, 673 bp, Homo sapiens
  misc_feature: GZ8MTXP01E0EPA.2.35.D02.1.454.CMB.2.raw
  modified_base (307)..(307): a, c, t, g, unknown or other
  misc_feature (307)..(307): n is a, c, g, or t
  modified_base (428)..(428): a, c, t, g, unknown or other
  misc_feature (428)..(428): n is a, c, g, or t
  modified_base (466)..(466): a, c, t, g, unknown or other
  misc_feature (466)..(466): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctccctcactcagggcacagggtcctgggcccagtctgccctgactcagcctccctccgccgtccgggtctcctggacagtcagtcaccatctcctgcactggaggcagcagtgacgttggcgttataactatgtctctggtatcaaccaacacccccggcaaacgccccccaaactcctacatttangacgtcaactacgcggtcccgttagggtcccctgtactcgtcttcgtctcggccctaccagtctggacctaaacgaccgggcccttacccgcgacccgttctacgtcggggcctccgtaanccgttaggaggagttcggagtacgtgtattacttacgngtcagcttacgattacgtgaccgagggcaacggactaacgggtctaaagtttcggtttaccggttttccgggggaacgggaacgggttaaccgaacggttccgtaccggtacccggttccccggtttgggttacccgaacccggaccccggtaaacgggtccccgttcccgggttacccccccgttaaccggttcccgttcccccgg

SEQ ID NO: 305844 - DNA, 682 bp, Homo sapiens
  misc_feature: GZ8MTXP01B7N0L.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacacccgcgaacgccccaaactcctcatttatgagtcaacgtaacgcggtacccgtttacgggggtccctgactcgtcttctcgtcggtccctaccgaagtcgtggaccaagaacccggccctccctcggacccgttctcgtcgggcctaccgaagtctaggacggattcggagggtacttaggtatttaagtttacgcgacgtacgtacctacggtattaacgtcgacgaacgggcacgcgaaacgtctaaacgttcggtttaaccggttttcggggaaccgggtaacgggaacccgtaaacggttccgttaacgggtaccccggttcccggttcggggttacccgtaacgggtaccccggaaaccgggtcccgtcccggttccccccggttaaccgggttaaccccgttaaccccg

SEQ ID NO: 305845 - DNA, 618 bp, Homo sapiens
  misc_feature: GZ8MTXP01A7WKU.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggaggcagcagtgacgttggcgttataactatgtctctgtatcaacaacaccccggcgaacgcccccaaactcctactatttangaggtacactaacggccggtccccgttagggggtcccctgactcgtcttctcgtcggcccctaccgaagtcgtggcaacggaacccgcccttcccgcgacccgttctcgtcgggcctaccgaagtcctaggacggtagtggaggtactaggttaatttaacgttactcgctaacgtcctacggtacttaagtcgacgaggccgaggcaaggcctaagttcgttaccgtttcgggaacgggaaggaccaggcgtcggtaccttcggttcgggccaaccggaccgtaacggcctcccggcccccgtcggccttcccg

SEQ ID NO: 305846 - DNA, 831 bp, Homo sapiens
  misc_feature: GZ8MTXP01EEJKH.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctccaccctcctcactcagggcacagggtcctgggcccagtctgccctgactcagcctccctccgcgtccgggtctcctggacagtcagtcaccatctcctgcacgtggagcagcagtgacgttggcgttataactntgtctctgtatacaacaaccgaccccggcgaaaccgacccccaaacttccctactatttaagtcggtaacgttaccaaccgtaaacggccggttaccccggttttacgggggtacccctttaggacgttccggttcctttcgtccgttcgggtaccccttacccgtaaaggtttcccgtcggacccgtaaaaccgggaaacccgggtcccttccccgtaccggttaccccgttccgttaccgggtcggggtacccttaccgaacggtcgtacgggtaaggacgttacgggaggtaccgttaaggttaactttaacgttaacgttcgacgtacgtaccttagtaactttaggtacgaccgaacgggacaacggtaccgaaggtacccttaaaggtttaccgggtttaaccgggttttccgggggaacgggtaacggggttaaaccctaaacggggttcccgtaacccggggtaacccggtttccgggttccggggttaacccgaacccgggttaccccggtaacggggttccccgttaccccgggttacccccggtttaacccggttcccgtttaaccccgg

SEQ ID NO: 305847 - DNA, 671 bp, Homo sapiens
  misc_feature: GZ8MTXP01BEKEY.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcacgccctccctccgcgtccgggtctccgtggacagtcagtccaccatcctcctgcacgtggagcagctagtgtacgttggacgttaataactgtcgtcctcgtaggtaactacaaaccaacctcccgtaggacccgaaacccgtacccccctaaactccttatactttagcggagtaccacgtaacgtccgggtacccgttacgggtcctaggctcgtcttcgcgtccgactacgagtcgcggaacacggtccgccctcctgtacctcgtcggtacgggcctacgaagcgtaggaggtagtggtacgtcttagtaacttacgtacgtcgataccgtcgtataaagtcgacgagacggacacgacgtactacgtaagtttccggtaacgggttcggggaccgggaacggtaccgacgtccggtaccggttacccgggtttcgccgggtaaccacccggtaaccgtacggttccccgaccccggttccccggttccgtttaaccccg

SEQ ID NO: 305848 - DNA, 575 bp, Homo sapiens
  misc_feature: GZ8MTXP01D7ZJQ.2.35.D02.1.454.CMB.2.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggagcagcagtgacgttggcgttaataactntgtctctggtatcaaacaacaccccggcaaacgcccccaaactcctcatttangaaggtcaactaagcggcccgttagggtccctgactcgcttctctgcctaccaagtctggcaagaccgcctcctgacctctcgtgggccttcaagctgagagtcgagtctacgtattacgttactcgcaacgctacggtataatggacaggcaacggcagctaagtcgttacgttttcgggcggtaaggaccgaacgacgtcgtaccggttccgttcgggttaccgaacgacccgtaacgtcccgtaccggttccccgtccggttctaacccg

SEQ ID NO: 305849 - DNA, 709 bp, Homo sapiens
  misc_feature: GZ8MTXP01AYFA7.2.35.D02.1.454.CMB.2.raw
  modified_base (252)..(252): a, c, t, g, unknown or other
  misc_feature (252)..(252): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccaggtctcctgacagtcagtcaccatctcctgcactgggacggcagctaggtcgtacggttggacgtttaanaactatcgtctccgtggtaacaccaaacacccgaccccgggacgaaacccgacccccctaaactcccctactaagttttacgacggtaacggttaccaacgtaaacgggccccggttaccccggtttaacggggttcccctaggtaccgttcgtccttcgtcgtccggtacctacgtaagttccacggaacgaacggtaacccggtccctacccggtacgacccgtttcgtacgggtcgggtaaccctacgtaacggcgtaggacggtagtacggtacggtacttaggtaactttacgtacgttacggtacacgttactacgtaaacgttcgacggacgacggacgacgtacgagtaccgtaagtttcggtacgtttcgggacggttaacggacgagcgtcgacgttcggttcgtaacgacgtaaccgtacgcccgttccgtcccgcggttaacccg

SEQ ID NO: 305850 - DNA, 612 bp, Homo sapiens
  misc_feature: GZ8MTXP01DKJRX.2.35.D02.1.454.CMB.2.raw
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttaataactatgtctctgtatcaacaacaccccggcaaacgcccccaaactcctcatttangagtcactaagcgtccgttagggtccctgactcgcttctctggccctaccaagtctggacaacggaaccggtccctccctagtacccgttctccgttcggggactacccgaagcgtaggaagggattaggaggaccgttagtaagtttacttaaccggtcgacgtatctacgtagtacgtagacgacgactacgacgaacgtacgtaagttcgttaccggttcgggaacggaacggaacgtaacgcgtacggtaccgttcgttcggacgaacgtacccgaacggtcctcccgttaccccgtcggttctaaccg

SEQ ID NO: 305851 - DNA, 685 bp, Homo sapiens
  misc_feature: GZ8MTXP01AI4UN.2.35.D02.1.454.CMB.2.raw
  modified_base (254)..(254): a, c, t, g, unknown or other
  misc_feature (254)..(254): n is a, c, g, or t
  modified_base (315)..(315): a, c, t, g, unknown or other
  misc_feature (315)..(315): n is a, c, g, or t
  modified_base (384)..(384): a, c, t, g, unknown or other
  misc_feature (384)..(384): n is a, c, g, or t
  modified_base (562)..(562): a, c, t, g, unknown or other
  misc_feature (562)..(562): n is a, c, g, or t
  modified_base (585)..(585): a, c, t, g, unknown or other
  misc_feature (585)..(585): n is a, c, g, or t
  modified_base (652)..(652): a, c, t, g, unknown or other
  misc_feature (652)..(652): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctcgccctgactcacgccctccctccgcgtccgggtctcctggacagtcagtccaccatctcctgcacgtggagcagcagtggacgttggcgttaatactntcgtctctggtatacaaacaaccgaccccggacaaccgcccccaaactcctactaatttanacggacggtacaacgtaacggcccggtaccccggtttagggggtacccctgtacgttccgtcgtttccnccgtacggtccccttaccggacgtcgtacgggaccgaaacgggtaacccgggtccccttcccgtacgggtacccgtttccgtcggtccgggggtacctacccggtaaagtccgttaagggacgggtacggtcgggaaacggtcgttaggtaactttagttacgcgtacacgttcactntacgtgccgaaggcgagaccggntagtacgttaggtttaccgttcgggaacgggacgttaccgaaggcgtacggacgttcggttcggacncgcgaacgccgccggttccctcggttcctcccg

SEQ ID NO: 305852 - DNA, 763 bp, Homo sapiens
  misc_feature: GZ8MTXP01BVRR3.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcacgtggagcagcagtgacgttggacgttataactatcgtctcgtgtactacaaaccaaccgaccccggacgaaaccgaccccctaaactcccttactaatttagtcggaacggttacaacgtaacggcccggtaccccggtttacggggtcccctagtacgttccgtcctttccgtcgtcggtccccttaccgtaacgtcgtagggacctaaacgggaacccggtcccttcccgtcggtaccccgttcgtccggtcggggtacctaccgaacggtcgtagggaggtaagtgggacggtacgttagttaaactttcgttaacgtcgtactacgtctaacgtacttagtcgacgacggaccgaggtacgaacgtaacgttaacgtttacggttttaaccggtttacgggggaacggggttaacgggaacccgtaaacgggttaccgttaccgggtaccccggttaccgggttcgggttacccaacccgggtacccggtaacgggtccccgttcccgggttcccccgttaacgggttccccgttaacccg

SEQ ID NO: 305853 - DNA, 593 bp, Homo sapiens
  misc_feature: GZ8MTXP01EX5S1.2.35.D02.1.454.CMB.2.raw
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
  modified_base (555)..(555): a, c, t, g, unknown or other
  misc_feature (555)..(555): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggagcagcagtgacgttggacgttataactntgtctctgtatcaacaacacccggacgaacgacccccaaactcctctatttangagtcaactacgcggtcccgttacggggtccctgtactcgtcttcgtcgtcggtcctacctaagtcgtaggctaaacgggaaaccgtccctcccgtacgtacccgtcttccgtacgggctaccgaagcgtggaggatggagtctagtatttagttaacngactagcctgtaatactgacgaggccaagtnaaggtctaaattcggttaacgtttcgggaacggtacggacgaacgttcgtacgccgttcgnggttacgcgacgaacgccgtccgccctcggttcctccg

SEQ ID NO: 305854 - DNA, 695 bp, Homo sapiens
  misc_feature: GZ8MTXP01EVWK9.2.35.D02.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (312)..(312): a, c, t, g, unknown or other
  misc_feature (312)..(312): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcacgcctccctcgccgtccggtctccgtggacagtcagtccaccntctccngcacgtggagcagcagtgtacgttgcgttaataactntgtctctgtatcaacaccgacccgacgaaccgaccccctaaactcctactaatttacgnggtacgtacaacgtaacggcccggtaccgttacgggtcccctagtactcgctttctcgtcggacccctacgtacgtcgtcggacgaaacgtaacccgcccttccgcgacccgttcgtcggtcgggcctaccgaagtcgtaggacggtagtaggacggtacgtagttaacgttacgttacgtacggacctaagttcccttaagggtatttaacggcgacgacggaccgaggtaccagtacgttaagttacggttaccggtttacggggaacgggtaacggaaccgtacggttaccgtacgggtaccggttccggttacggggttccgaaccggacccgtaacgggtcccgtcccggttaccccgttccgttaacccgttccccg

SEQ ID NO: 305855 - DNA, 743 bp, Homo sapiens
  misc_feature: GZ8MTXP01BV3TC.2.35.D02.1.454.CMB.2.raw
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcacgtggagcagcagtcgacgttggcgttataactntgtactcgtgtatacaacaacacccgganaaccgaccccaaactcctactatttanacgtacgtcacgtacgccggtaccgttacggggtccctgactcgtcttcgtctcggtcctccgaagtctacgggacaaacgggaacccgtccctcccgtacggtacccgtccgtacggtcgggacctaccgaagtcgtaggagggtagtggaggtacgttagttaatttacgttacgtcgacgtacgtccttacgtaagttacggtacggacgaacggtacgtaacggtaccgaaacgttacgttaaaacggtttccgggtttaaccgggttttccgggggaaaccgggggtaaaccgggttaaacccggtaacgggttacccgttacccgggtaacccgggttccgggttacggggttcccgaacccgggtacccggtaaccgggttccccgtaccccgggttacccccggttccgggttcccgttaacccccgg

SEQ ID NO: 305856 - DNA, 718 bp, Homo sapiens
  misc_feature: GZ8MTXP01A7U20.2.35.D02.1.454.CMB.2.raw
  modified_base (254)..(254): a, c, t, g, unknown or other
  misc_feature (254)..(254): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (511)..(511): a, c, t, g, unknown or other
  misc_feature (511)..(511): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcacgcctccctccgcggtccggtctcctggacagtcagtcaccatctcctgcacgtggaggcagcagtgtacggttggtgttataactntgtctcgtggtatacaacaaccgaccccggacgaacccgaccccaaactcctntatttangacgtacaacgtacggccggtacccgttacggggtccctgactccgtcttctcgtcggtccctaccgtagtcgtacggaccgtaaacggaacccggtcccgtacccgtcggtaccccggttccgtccgggtccgggtaccctaccgaacggtcgtaggacggtagtacgggagtcgttaagttactttaagttccgngtcacgtacctagtaacgtacgcggacgacgacacgagtaacgtaacgttaacgttacggtttaccgggttacggggtaacggggtaacgggaaccggtaaccggttaccggtaccggtacccgggttccgggttccgggttaccggtaacccggacccggtaaccggtcccggtccccggttaccccggttcccgttcccgtcccg

SEQ ID NO: 305857 - DNA, 507 bp, Homo sapiens
  misc_feature: GZ8MTXP02IF4UK.2.35.D02.1.454.CMB.2.raw
  modified_base (242)..(242): a, c, t, g, unknown or other
  misc_feature (242)..(242): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggcggttanaactatgtctcctggtatcaacaacaccccggcgaacgcccccaaactcctacatttatgaggtcactaagcgcccttaggggtccctgatcgcttctctgcctccaagtctggcagaacgcctcctgacctctctggctccaagctgagatgagctgattatactgcagctcattatgcagcagcagcaatgtactttcggcggtaggaccaagtctcgaccgtcctggtcaagcccaaggccagtccccctcggttacacccg

SEQ ID NO: 305858 - DNA, 504 bp, Homo sapiens
  misc_feature: GZ8MTXP02H4Q4T.2.35.D02.1.454.CMB.2.raw
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
tcagacgctcgacacacgaccggtgctcgatttagcacacgatagttgggtttggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaacgccccccaaatcctcatttatgaggtcactaagcggccttagggtccctgatcgcttcnctgcctcagtcngcagacgctccngcccgtntcgtggctccanctgagatgagctgattattactgcagctcatatgcaggcagcagcaatgtactttcggcggtaggaccaagctacgaccgtcgtggacaacgccgaacggcctcgcccccgtcggtccacc

SEQ ID NO: 305859 - DNA, 516 bp, Homo sapiens
  misc_feature: GZ8MTXP02IGXEV.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctcctggtatcaaacaacaccccggcgaagcccccaaaactccctcatttatgaggtcactaagcggcccttaggggtcccctgatcgcttctctggcctccaagtctgcagaacgcctcctgaccgtctctggctccaagcngagntgagctgattatatgcagctcattatgcagcagcagcaatgtactttcggcgtagggacccaagctacgaccgtcctggtccaacggcccaaggcctacggccccctcggtacctaccg

SEQ ID NO: 305860 - DNA, 508 bp, Homo sapiens
  misc_feature: GZ8MTXP02H4ILQ.2.35.D02.1.454.CMB.2.raw
  modified_base (345)..(345): a, c, t, g, unknown or other
  misc_feature (345)..(345): n is a, c, g, or t
  modified_base (383)..(383): a, c, t, g, unknown or other
  misc_feature (383)..(383): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggcggttataactatgtctcctggtatcaaacaacacccccggcgaacgcccccaaaactccctcatttatgaggtcactaagcgcccttaggggtccctgatcgcttcnctggcctccaagtctggcagaacgcctcctgacccgtntcctgggctccaagctgagatgagctgattatactgcagctcatatgcaggcagcagcaatgtactttcggcggaggaccaagctgaccgtcctggtcaagcccgaagctcgcccctcggtccac

SEQ ID NO: 305861 - DNA, 504 bp, Homo sapiens
  misc_feature: GZ8MTXP02HBT92.2.35.D02.1.454.CMB.2.raw
  modified_base (413)..(413): a, c, t, g, unknown or other
  misc_feature (413)..(413): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaaacaacaccccggcgaaacgccccccaaaactcctacatttatgaggtcactaagcggcccttaggggtccctgatcgcttctctgcctcaagtctggcagaacgcctcctgaccgtctctggctccaagctgagatgagctgattatacngcagctcatatgcagcagcagcaatgtactttcggacgaggaccaagctagaccgtcctgggtcaacgccaaggctcgccccgtcgtcacc

SEQ ID NO: 305862 - DNA, 514 bp, Homo sapiens
  misc_feature: GZ8MTXP02ISQUS.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcaacgccccccaaatcctcatttangagtcactaagcggcccttaggggtcccctgatcgcttctctggcctcagtctggcagaacgcctccctgaccgtctcgtgggctccaagctgaggatggaggctgtatttattactgcagctcattatgcaggcagcagcaatgtactttcgggcgtagggaccaagctcgaccgtctgggtcaagcccaaggcctcgccccctggtctacc

SEQ ID NO: 305863 - DNA, 495 bp, Homo sapiens
  misc_feature: GZ8MTXP02H383U.2.35.D02.1.454.CMB.2.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctcctggtatcaacaacaccccggcaagcccccaaactcctcatttangaggtcactaagcgccttaggggtccctgatcgcttctctggcctcaagtctgcagaacggcctcctgaccgtctctggctccaagctgagntgagctgattatactgnagctcatatgcaggcagcagcaatgtacttttcggacgagggaccaagctcgaccgtctggtcaagccgaagctgcccctggctacg

SEQ ID NO: 305864 - DNA, 500 bp, Homo sapiens
  misc_feature: GZ8MTXP02G2HJ4.2.35.D02.1.454.CMB.2.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctcctggtatcaacaacaccccggcgaacgcccccaaactcctcatttangaggtcactaagcgccttagggtccctgatcgcttcnctggcctcagtctgcagaacggcctcctgaccgtctctgggctccaagctgagatgagctgattattacngcagctcattangcaggcagcagcaatgtactttcggcgagggaccaagctacgaccgtcgnggtcngccaaggctcgcccctcggtctaccg

SEQ ID NO: 305865 - DNA, 557 bp, Homo sapiens
  misc_feature: GZ8MTXP02HAC0K.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggacgaacgcccccaaactcctactatttangaggtcaactaagccggtcccgttaggggtccctggactcgcttctctggccctacagtctggcacgacgcctcctgacccgtctcgtcgggcctaccaagtctagaggatggaggtctagtatttattactgcagtctacattatgacgagacagcaagctaagttgttaacgtttcgggacggacgggaccaagtcgtacgaccgtccgtggtacaacgcccgaacggtcctccgcccccgtcggtacctccg

SEQ ID NO: 305866 - DNA, 552 bp, Homo sapiens
  misc_feature: GZ8MTXP02JVOUU.2.35.D02.1.454.CMB.2.raw
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
  modified_base (413)..(413): a, c, t, g, unknown or other
  misc_feature (413)..(413): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttangagtcactaagcggcccttagggtccctgatcgcttcnctggcctcagtctggcagacgcctccgtgaccgtntctgggctcccaagctgagatgaggctgatttattacgngacagctacatagtgacgaggcagacagactaagttcgttacgttcgggacggacggaccacggtccgtacggtacccgtcggtacggtaccgaaccgacccgtacggtcccgtcccggcccccgttcggtacctaccg

SEQ ID NO: 305867 - DNA, 509 bp, Homo sapiens
  misc_feature: GZ8MTXP02I00QL.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaaacaacaccccggacgaacgcccccaaactcctacatttangagtcactaagcgccttaggggtccctgatcgcttctctgcctccaagtctggcagaacgcctcctgaccgtctctggcctccaaagctgaggatgagctgattatactgcagctcatatgcaggcagcagacaatgtactttcggcggagggacaagctacgaccgtcgtggtcaagcccaaggcctcgcccctcggtcctaccg

SEQ ID NO: 305868 - DNA, 508 bp, Homo sapiens
  misc_feature: GZ8MTXP02G4RMT.2.35.D02.1.454.CMB.2.raw
  modified_base (300)..(300): a, c, t, g, unknown or other
  misc_feature (300)..(300): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttangagtcactaagcggccttaggggtccctgatcgcttctctggcctcagtctggcagacgcctcctgaccgtctcgtggctccagctgagatgagctgattatactgcagctcatatgcaggcagcagcaattgtactttcggacggtaggaccagctacgaccgtctcgggtacaacgcccgaaggcctcgccccctcggtactaccg

SEQ ID NO: 305869 - DNA, 541 bp, Homo sapiens
  misc_feature: GZ8MTXP02GVLR3.2.35.D02.1.454.CMB.2.raw
  modified_base (243)..(243): a, c, t, g, unknown or other
  misc_feature (243)..(243): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctcctggtatcaaacaacaccccggcgaacgcccccaaactcctacatttatgaggtcactaagcggtcccgttaggggtccctgactcgcttcnctgcctcagtctgcagacgcctccngaccgtctctggctccaagctgagatgagctgattattacgngacagctacatangacgagacagcagactaagtcgttacgttcgggacggacggaccaacgtcgtacggacccgttcgtacgggacaacggacccgaacggtcctccgtcccccgtcggtacctaccg

SEQ ID NO: 305870 - DNA, 507 bp, Homo sapiens
  misc_feature: GZ8MTXP02J29Q4.2.35.D02.1.454.CMB.2.raw
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaaccaccccggcgaacgcccccaaactcctcatttatgagtcactaagcggccttagggccctgatcgcttcnctggccctcagtctggcaggacgcctcctgaccgtntcgtgggctccaagctggacgtatggagctgatttatactgcagctcatatgcaggcagcagcaatgtactttcggcggaggaccaagctacgaccgtccgtggcaagcccaaggcctcgtccctcggtcaccg

SEQ ID NO: 305871 - DNA, 517 bp, Homo sapiens
  misc_feature: GZ8MTXP02IILPJ.2.35.D02.1.454.CMB.2.raw
  modified_base (244)..(244): a, c, t, g, unknown or other
  misc_feature (244)..(244): n is a, c, g, or t
  modified_base (405)..(405): a, c, t, g, unknown or other
  misc_feature (405)..(405): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanaactatgtctcctggtatcaaacaaccaccccggcgaaacgcccccaaaactcctacatttatgaggtcactaagcggccttaggggtccctgactcgcttctctgcctccaagtctggcagaacgcctcctgaccgtctcgtcgggctccgaagctgagntgagctgattatactgcagctcatatgcagcagcagcaatgtactttcggcgtacggacaatcgtagaccgtctagggtcaacgccaaggctacgccccctcggtactaccg

SEQ ID NO: 305872 - DNA, 512 bp, Homo sapiens
  misc_feature: GZ8MTXP02JZVO5.2.35.D02.1.454.CMB.2.raw
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgcccccaaactcctcatttatgaggtcactaagcggcccttaggggtccctgatcgcttctctggcctccagtctggcagaacggcctcctgaccgtctctgggcctccagctgagatgagctgattatactgcagctcatatgcaggcagcagcaatgtactttcggcggtaggaccaagctcgaccgtccgtgggtcaagtcccgaaggctcgccccctcggtctaccg

SEQ ID NO: 305873 - DNA, 518 bp, Homo sapiens
  misc_feature: GZ8MTXP02IXNIB.2.35.D02.1.454.CMB.2.raw
  modified_base (307)..(307): a, c, t, g, unknown or other
  misc_feature (307)..(307): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaaccaccccggcgaacgccccccaaactccctcatttangaggtcactaagcggccttaggggtccctgatcgcttctctggcctcagtctggcagacgcctcctgaccgtctctgggctccaagctgagatgaggctgattattacngctagctnatatgcaggcagcagacaatgtacgtttcggacggtaggaccaagctagacccgtcgtgggtcaacgcccaaggctcggccccctggtcctacg

SEQ ID NO: 305874 - DNA, 508 bp, Homo sapiens
  misc_feature: GZ8MTXP02JS89I.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcgaacgcccccaaactcctacatttangagtcactaagcggcccttaggggtccctgatcgcttctctggcctccatctggcagacggcctcctgaccgtctctgggctcccaagctgaggatgaggctgattattactgcagctcatatgcaggcagcagcaatgtacttcggcggaggaccaagctacgaccgtcgtgggtcaagcccaaggctccgccccgtcggtcaccg

SEQ ID NO: 305875 - DNA, 648 bp, Homo sapiens
  misc_feature: GZ8MTXP02I6OC5.2.35.D02.1.454.CMB.2.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggnaagcccccaaaatccctacattttanaggtcgtactaacgtacggcccgttacgggtaccggtccagtacgtccgttcttcctcggtcgtcccctaacgtacgttcgtacgactaaacggcccgtccccttccgacggtacccgttcctcgggtcggtaccctacgaactcgtaggagtgtaggcgtntagttaatttacttacgnacgtactcctataattgcgacgacggacacgacgacgaacttagttacgttttaccggttacgggacggggaaccgaaccgacggtcgttaaccggtacccgttcgggtcgtaaccgaacccggtaacggacgtcgtcccccgtcccggttacgaccgtttcccg

SEQ ID NO: 305876 - DNA, 520 bp, Homo sapiens
  misc_feature: GZ8MTXP02GTSKY.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaacgcccccaaactcctcatttatgaggtcactaagcggcccttaggggtccctgatcgcttctctggcctccaagtctggcagaacgcctcctgaccgtctctgggctccaagctgagatggagctgattattactgcagctcattatgcagcagcagcaatgtactttcggcggtaggaccaagcgtacgaccgtccgtgggtcaacgcccgaaggcctccgccccctcggtacctaccg

SEQ ID NO: 305877 - DNA, 501 bp, Homo sapiens
  misc_feature: GZ8MTXP02G1RWV.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaacgcccccaaatcctcatttangagtcactaagcgccttagggccctgatcgcttctctgcctcagtctggcagacgcctcctgacctctctgggctcaagctgagatgagctgattatactgcagctacatatgcaggcagcagactaatgtactttcggcggaggacaagtctcgaccgtccgtggtcaagcccgaaggcctacgcccctcggtctaccg

SEQ ID NO: 305878 - DNA, 529 bp, Homo sapiens
  misc_feature: GZ8MTXP02G4LIS.2.35.D02.1.454.CMB.2.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttanaactatgtctcctggtatcaacaacaccccggcgaacgccccccaaaactcctactatttangaggtcaactaagcggccttaggggtccctgatcgcttctctggcctccaagtctggcagaccggcctccctgacccgtctcgtgggcctcaagctgagatgagtctgattatactgcagctnatatgcaggcagcagctaatgttactttcgggacggaggaccaagcgtacgaccgtcgcgggtacaacgcccgaaggtcctcgcccccgtggtcctaccg

SEQ ID NO: 305879 - DNA, 532 bp, Homo sapiens
  misc_feature: GZ8MTXP02HXPVA.2.35.D02.1.454.CMB.2.raw
  modified_base (243)..(243): a, c, t, g, unknown or other
  misc_feature (243)..(243): n is a, c, g, or t
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctctgtatcaacaacaccccggacgaacgccccccaaactcctactatttangaggtcactaagcggccttaggggtccctgatcgcttcnctgcctcagtctgcagacgcctcctgaccgtctctggctccaagctgagatgagctgtattatactgcagctacatatgcagcagcagcaatgttacgtttcgggcggtacggaccaacgtcgtacgtacccgttccgtacggtacaacgacccgaacggtccctaccgtcccccgtcggttaccctccg

SEQ ID NO: 305880 - DNA, 673 bp, Homo sapiens
  misc_feature: GZ8MTXP02HCUNK.2.35.D02.1.454.CMB.2.raw
  modified_base (404)..(404): a, c, t, g, unknown or other
  misc_feature (404)..(404): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttaatactatgtctctggtatcaacacaccccggcgaaacgccccccaaactcctactatttactgtacggtcaactaaggccggtacccgttaggggtcccctggactccgcttctcgtggccctccaagtctggcacggaccgtcctacccgtgacccgttntcgtcggggcctacccgaaagtccttaggagggtattgggaacgggtccttaggtaattttacgtttaacgtcggactaacggccttacgtatttaagcggaccgaaagggccaaggccaaggtacctaaaagtttcggttaaaccgttttccggggaccgggtaaacggggtaacccaaacggtcgtacggtacccgttccggtcggggtaccaaccggtacccccgaaagggtccctacccggtcccccgttacggtcccttacccg

SEQ ID NO: 305881 - DNA, 515 bp, Homo sapiens
  misc_feature: GZ8MTXP02FR3S3.2.35.D02.1.454.CMB.2.raw
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcaacgcccccaaactcctcatttangagtcactaagcggcccttaggggtccctgatcgcttctctggcctccagtctggcagacgcctccngaccgtctcgtgggctccaagctgagatggagctgattagttactgcagctcatatgcagcagcagcaatgtacgtttcggacggaggaccaagcgtcgaccgtcgtggtcaacgcccgaaggtcctccgccccgtcggtctaccg

SEQ ID NO: 305882 - DNA, 551 bp, Homo sapiens
  misc_feature: GZ8MTXP02GL7BB.2.35.D02.1.454.CMB.2.raw
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaaacaacaccccggnaacgcccccaaactcctacatttangagtcactaagcgccttagggccctgactcgctctctggcctcagtctggcagacgcctccngaccgtctcgtggctccaagctgagatgagctgattatacgncagtctatatagngacgagacagacaacgtactaagttcgtttacgttcgggacgggtaacggaaccaacggtcgtacggtacccgttacggtcgggaccaaccggtacccgaacggtccctcccggtccccgtacggtacctaccg

SEQ ID NO: 305883 - DNA, 533 bp, Homo sapiens
  misc_feature: GZ8MTXP02FKHN7.2.35.D02.1.454.CMB.2.raw
  modified_base (486)..(486): a, c, t, g, unknown or other
  misc_feature (486)..(486): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaacgcccccaaactcctcatttatgaggtcactaagcggcccttaggggtccctgatcgcttctctggcctcagtctggcagaacggcctccctgaccgtctctgggctccaagctgagatgaggctgattattactgcagctcatatgcaggcagcagcaatgttactttcggacggtagggaccaaaggcctcggaaccgttccgnggggttaccaacggccccaagggcctcggcccccgtcggtctacccg

SEQ ID NO: 305884 - DNA, 546 bp, Homo sapiens
  misc_feature: GZ8MTXP02JA7S6.2.35.D02.1.454.CMB.2.raw
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgccccccaaaatcctcatttangaggtcactaagcggccttaggggtccctgatcgcttctctggcctcagtctggcagaacgcctcctgaccgtctcgtgggcctccaagctgagatgaggctgattattacngcagctanatangacaggcagcagactaagttcgttacgttcggggacggaagggaaccaaggtctacggacccgttcggtcggtaccaacgacccgtaacggccgtccgtcccccgttcggtacctacg

SEQ ID NO: 305885 - DNA, 569 bp, Homo sapiens
  misc_feature: GZ8MTXP02JA2OY.2.35.D02.1.454.CMB.2.raw
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (421)..(421): a, c, t, g, unknown or other
  misc_feature (421)..(421): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacacacccgcgaacgccccaaactcctcatttangagtcactaagcgtccttaggggtccctgactcgcttctctggcctccagtctggcacgaacggccctcctcgaccgtctcgtgggcctccaagctagaggactggagctgtaatttacttacgngctacgtctactagtgcgacgacggcacgcagactaagttcgttacggtttcgggacggtaacggaccacggtccgtacggtacccgtcggtacggtaccgaaccggacccgtaacggtcccgtcccggtaccccgtcgtaccctccg

SEQ ID NO: 305886 - DNA, 531 bp, Homo sapiens
  misc_feature: GZ8MTXP02GST95.2.35.D02.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanaactatgtctctggtatcaacaacaccccggcgaacgcccccaaactcctacatttangagtcactaagcggtccttaggggtccctgatcgcttctctggcctcagtctggcagaacggcctccctgaccgtctcgtgggctccagctgagntgagctgattatactgacagctnatangacaggcagcagcaagtgttacgtttcgggacggtacgggacaagtcgtacgacccgtcgtgggtaccaacggacccgaaggtcctcggtccccgtcggtcctaccg

SEQ ID NO: 305887 - DNA, 563 bp, Homo sapiens
  misc_feature: GZ8MTXP02JSYV2.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttangagtcactaagcggcccttaggggtccctgatcgtcttctcgtggcctccagtctggcagacgcctcctgaccgtctctgggctccaagctgagatgagctgattatactgcagctcatagtgcgaggcagcgagctaagttgttaacgtttcgggacgggtaacgggaccaaacggtcgtacggtacccgttccgtcgggggtaccaaccggtaccccggaaacggtcccgtaccggccccccgttcgggtaccctacccg

SEQ ID NO: 305888 - DNA, 513 bp, Homo sapiens
  misc_feature: GZ8MTXP02I2F5D.2.35.D02.1.454.CMB.2.raw
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggcgaaacgcccccaaaactccctacatttangaggtcaactaagcggccttaggggtccctgactcgcttctctggcctccagtctggcagacgcctcctgaccgtcnctggctcaagctgagatgagctgattactatgcagctnatatgcagcagcagacagtgtacgtttcggacggaggtaccaagctacgaccgtcgtgggaccaagcccaaggctcgcccctcggctaccg

SEQ ID NO: 305889 - DNA, 520 bp, Homo sapiens
  misc_feature: GZ8MTXP02H5IAK.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
  modified_base (426)..(426): a, c, t, g, unknown or other
  misc_feature (426)..(426): n is a, c, g, or t
  modified_base (505)..(505): a, c, t, g, unknown or other
  misc_feature (505)..(505): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctcctggtatcaacaacaccccggcaacgcccccaaactcctcatttatgaggtcactaagcgccttagggccctgatcgcttcnctgcctcaagtctggcagaacgcctcctgaccgtctctgggctccgaagccgtagacggatggaggctagattatactgcagcttcattangacgagcagacagactaagttcgttacgttcgggacggacggacagcgtacgaccgtcgtcggcaacgaccgacgtccnccgccctcgtactcg

SEQ ID NO: 305890 - DNA, 517 bp, Homo sapiens
  misc_feature: GZ8MTXP02IIPCT.2.35.D02.1.454.CMB.2.raw
  modified_base (307)..(307): a, c, t, g, unknown or other
  misc_feature (307)..(307): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggcgaacgccccccaaaactccctcatttangagtcactaagcgccttaggggtccctgatcgcttctctggcctccaagtctggcagaacggcctcctgacccgtctctgggctccgaagctgagatgagctgattattcngcagctnatatgcagcagcagcaatgtaactttcggcggaggtaccaagtcagtaccgtcgtggtcaagtcccaaggcctacgccccctcggtctaccg

SEQ ID NO: 305891 - DNA, 515 bp, Homo sapiens
  misc_feature: GZ8MTXP02FZQ6V.2.35.D02.1.454.CMB.2.raw
  modified_base (248)..(248): a, c, t, g, unknown or other
  misc_feature (248)..(248): n is a, c, g, or t
  modified_base (479)..(479): a, c, t, g, unknown or other
  misc_feature (479)..(479): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactntgtctcctggtatcaacaacaccccggcgaacgcccccaaactcctcatttatgaggtcactaagcggcccttagggtccctgactcgcttctctggcctccaagtctggcagacgcctccctgaccgtctctgggctccaagctgagatgaggctgtattattactgcagctacgatatgcagcagcagcatgtactttcggacggagggaccaaggctacgaccgtcgnggtacaacgcccgaaggcctcgcccctcggctaccg

SEQ ID NO: 305892 - DNA, 547 bp, Homo sapiens
  misc_feature: GZ8MTXP02GHP7L.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctggtatcaacaacaccccggcaacgcccccaaactcctcatttatgaggtcactaagcggtcccttaggggtccctgatcgcttctctggcctcagtctgcagacgcctcctgaccgtctcgtggcctcaagctagagatgagctgattattacngcagctanatagtgacgagcagcgagactagttcgttacgttcgggacgggtaacggaaccaacgtccgtacggtaccgtacggtcggtaccgaacggacccgtacggcccgtacccgtcccccgtcgtaccctaccg

SEQ ID NO: 305893 - DNA, 503 bp, Homo sapiens
  misc_feature: GZ8MTXP02IKAVJ.2.35.D02.1.454.CMB.2.raw
  modified_base (297)..(297): a, c, t, g, unknown or other
  misc_feature (297)..(297): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (455)..(455): a, c, t, g, unknown or other
  misc_feature (455)..(455): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggcgttataactatgtctctggtatcaacaacaccccggcaacgcccccaaatcctcatttangagtcactaagcggccttaggggtccctgatcgcttctctggcctccagtctgcagacgcctcctgaccgtctctggctccaagctgagatgagctgtattattacngcagctnatatgcaggcagcagacatgtacgtttcggacggaggaccagcncgaccgtccgtgggtcaagccccaaggcctcgcccccgtggtctaccg

SEQ ID NO: 305894 - DNA, 504 bp, Homo sapiens
  misc_feature: GZ8MTXP02HCU9O.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctgtatcaacaacaccccggcgaacgcccccaaactcctcatttatgaggtcactaagcgccttaggggtccctgatcgcttctctggcctccagtctggcagacggcctcctgaccgtctcgtgggctccaagctgagatgagctgattatactgcagctcatatgcagcagcagcaatgtactttcggcggaggaccagcacgaccgtcgtcggtcaacgcccgaaggctcgcccctcggtcctacg

SEQ ID NO: 305895 - DNA, 508 bp, Homo sapiens
  misc_feature: GZ8MTXP02FHKEB.2.35.D02.1.454.CMB.2.raw
  modified_base (302)..(302): a, c, t, g, unknown or other
  misc_feature (302)..(302): n is a, c, g, or t
  modified_base (475)..(475): a, c, t, g, unknown or other
  misc_feature (475)..(475): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaaacgcccccaaactcctcatttangagtcataagcgccttaggggtccctgatcgcttctctggcctccaagtctggcagaacggcctcctgaccgtctcgtgggctccaagctgagatgagctgattatactgcagctcatactgcaggcagcagcaatgttactttcggcgagggaccaaagctagaccgtccgngggtcaacgcccaaggctcggcccctggcctac

SEQ ID NO: 305896 - DNA, 529 bp, Homo sapiens
  misc_feature: GZ8MTXP02IN3A2.2.35.D02.1.454.CMB.2.raw
  modified_base (244)..(244): a, c, t, g, unknown or other
  misc_feature (244)..(244): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcccgcactggagcagcagtgacgttggcggttanaactatgtctcctggtatcaacaaacaccccggcgaaacgccccccaaaactcctacatttatgaggtcactaagcgccttaggggtcccctgatcgcttctctggctcccaagtctggcagaaccggcctccctgacccgtctctgggctcaagctgaggatgaggctgattatactgcagctanatngnagcagcagactagttgttacgttcggacgtaacgaacagcgtacgaccgtcgtcggacacgaaccgacggcctccgcccgtcgtcctacgtccg

SEQ ID NO: 305897 - DNA, 508 bp, Homo sapiens
  misc_feature: GZ8MTXP02HHFGZ.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctcctggtatcaaacaacaccccggcgaacgcccccaaactcctcatttangaggtcactaagcggcccttaggggtccctgatcgcttcnctggcctccagtctggcagaacggcctccctgaccgtctctgggctccaagctgagatgagctgattatatgcagctcatatgcaggcagcagcaatgtactttcggcggtaggaccaagctcgaccgtcngggtcncgcctaaggctcgccccgtcggtctaccg

SEQ ID NO: 305898 - DNA, 564 bp, Homo sapiens
  misc_feature: GZ8MTXP02IYNK2.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctacatttangaggtcactaagcggccttaggggtccctgactcgcttctctggcctccaagtctggcagaacgcctccgtgacccgtctcgtcgggctccaagctgacgatgagctgtattattactgcagctacattatgacgaggacaggacagactaattcgttaacgtttcgggacggaacggtaaaccgaagcgtaccggtaccgtaccgttggggaccctaacggacccgaaacggtccgtcccgccccgttcggtacctacccg

SEQ ID NO: 305899 - DNA, 542 bp, Homo sapiens
  misc_feature: GZ8MTXP02FOODN.2.35.D02.1.454.CMB.2.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctcctggtatcaacaacaccccggcgaacgcccccaaactcctacatttangaggtcactaagcggcccttaggggtccctgatcgcttctctggcctccagtctgcagaacggcctcctgacctctctgggcctccaagctgagatgagctgtattattactgcagctacatatgcagcagcagcaatcgttacgtttcggacggtacggggaccaaagtccgtacggaccgttcccgtgggttccaacggaccccgtaaggccctccggccccctcggtcctaacccg

SEQ ID NO: 305900 - DNA, 506 bp, Homo sapiens
  misc_feature: GZ8MTXP02FVCOK.2.35.D02.1.454.CMB.2.raw
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (418)..(418): a, c, t, g, unknown or other
  misc_feature (418)..(418): n is a, c, g, or t
  modified_base (473)..(473): a, c, t, g, unknown or other
  misc_feature (473)..(473): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctcctggtatcaacaacaccccggcggacgcccccaaatcctcatttangagtcactaagcgcccttaggggtccctgatcgctctctggcctcagtctgcagacgcctcctgaccgtctctggctccaagctgagatgagctgattatactgcagctcatatganaggcagcagacaatgttacgtttgggacggacggacaacgcttcgaccgttccgngggtcaagccaaggcctcgcccctcggctaccg

SEQ ID NO: 305901 - DNA, 515 bp, Homo sapiens
  misc_feature: GZ8MTXP02IDQS9.2.35.D02.1.454.CMB.2.raw
  modified_base (250)..(250): a, c, t, g, unknown or other
  misc_feature (250)..(250): n is a, c, g, or t
  modified_base (487)..(487): a, c, t, g, unknown or other
  misc_feature (487)..(487): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactntgtctcctggtatcaacaacaccccggcgaaacgccccccaaaactccctaccattttatgaggtcactaagcggcccttaggggtcccctgatcgcttctctggcctccagtctggcagaacggcctccctgaccgtctctgggctccaagctgagatgagctgatttatactgcagctcatatgcaggcagcagcaatgtactttcggacggaggacaagctgaccgtctggtcngcccaaggcctcgccccctcggctaccg

SEQ ID NO: 305902 - DNA, 545 bp, Homo sapiens
  misc_feature: GZ8MTXP02G3CJZ.2.35.D02.1.454.CMB.2.raw
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctacatttangaggtcactaagcggcccttaggggtccctgatcgcttcnctggcctcagtctgcagaacggcctcccngaccgtctctgggctccaagctgagatgagctgattatatgnagctnatatgacaggacagcgaagacgtaagttacgttacgtttcgggacggtacggacgaacgcgtacgtaccgtcgtacggtaccgaaccgacccgtaacggccgtacccgccccgtaccgtacctaccg

SEQ ID NO: 305903 - DNA, 527 bp, Homo sapiens
  misc_feature: GZ8MTXP02IAUHX.2.35.D02.1.454.CMB.2.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacacccgcgaacgcccccaaactcctacatttangagtcactaagcgccttagggtccctgactcgcttctctggcctcagtctgcagaacgcctcctgaccgtctcgtggctccaagctgagatgagctgtattattactgcagtctacatatcgcagcagcagcatgtacgtttcggacggtaggaccaaggtccgtacggacccgttccgtggtaccgaacgacccgaaacggtcctccgcccccgttcggtcctacccg

SEQ ID NO: 305904 - DNA, 520 bp, Homo sapiens
  misc_feature: GZ8MTXP02JZG5D.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttatgaggtcactaagcgcccttagggtccctgatcgcttctctggcctcagtctggcagacgcctcctgaccgtctctgggctccaagctgagatgagctgattatactgcagctcatatgcgaggcagcagcaagttgtacgtttcgggcggtaagggaccaacggctacggaccgtccgtggtcaacgacccaagggcctcgcccccgtcggtctacccg

SEQ ID NO: 305905 - DNA, 509 bp, Homo sapiens
  misc_feature: GZ8MTXP02IXA9Z.2.35.D02.1.454.CMB.2.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (414)..(414): a, c, t, g, unknown or other
  misc_feature (414)..(414): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgcccctgactcagcctccctccgcgtccgggtctcctggacagtcagtcaccatctcctgcactggaggcagcagtgacgttggcgttataactatgtctctggtatcaacaacaccccggcgaacgccccccaaactccctcatttangaggtcactaagcggccccttaggggtccctgatcgcttcnctggcctccagtctgcagacgctcctgacctctctggctccaagctgaggatgaggctgtattattacngcagctcatatgcgagcagcagcaatgtactttcggacggtagaaccagctcgaccgtcgtggtcaagcccgtaagctcgcccctcggtctaccg

SEQ ID NO: 305906 - DNA, 507 bp, Homo sapiens
  misc_feature: GZ8MTXP02HNP25.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaaacaacaccccggcaacgcccccaaactcctcatttangagtcactaagcgcccttaggggtccctgatcgcttctctggcctccagtctggcagaacgcctcctgaccgtctcgtgggctccagctgagatgagctgattattactgcagtctacatatgacaggcagcagcaatgtactttcggcggtaggacagctacgaccgtccgtggtcaacgccgaacggctcgcccctctcgtacc

SEQ ID NO: 305907 - DNA, 510 bp, Homo sapiens
  misc_feature: GZ8MTXP02IZ7FX.2.35.D02.1.454.CMB.2.raw
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggagcagcagtgacgttggcggttataactntgtctcctggtatcaaacacaccccggngaacgcccccaaatcctacatttangagtcactaagcgcccttagggtccctgatcgcttcnctgcctcagtctggcagacgcctccgtgaccgtctctgggctccaagctgagntgagctgattatactgcagctcaatntgcaggcagcagacaagttgttacgtttcggacgggtacggaacacgctgaccgtctggtcaagcccgaaggctccgccccgtggtcctaccg

SEQ ID NO: 305908 - DNA, 511 bp, Homo sapiens
  misc_feature: GZ8MTXP02I9NEZ.2.35.D02.1.454.CMB.2.raw
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttangagtcactaagcggccttagggtccctgatcgcttcnctggcctccagtctggcagaacgcctcctgaccgtctctgggcctcaagctgagatgagctgattatactgcagctcatatgcaggcagcagacaatgtacgtttcggacggtaggaccaaagctcggaccgtccgtggtcaacgccctaggcctcgcccccgtcggtctaccg

SEQ ID NO: 305909 - DNA, 512 bp, Homo sapiens
  misc_feature: GZ8MTXP02FT7FI.2.35.D02.1.454.CMB.2.raw
  modified_base (300)..(300): a, c, t, g, unknown or other
  misc_feature (300)..(300): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttangagtcactaagcgccttagggtccctgatcgcttctctgcctccagtctggcagaacggcctcctgaccgtctctggctccaagctgagatgagctgattatactgcagctacatatgcaggcagcagcaatgttacgtttcggacggtacgggaccaagctcgaccgtccgtgggtacaacgcccgaaggcctccgcccctcggtctaccg

SEQ ID NO: 305910 - DNA, 554 bp, Homo sapiens
  misc_feature: GZ8MTXP02I3NQ6.2.35.D02.1.454.CMB.2.raw
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccggcaacgcccccaaactcctcatttangaggtcaactaagccggtcccttaggggtcccctgatcgcttctcgtggcctccagtctggcagacgcctccngacctcnctggctcagctgagntgngctgtattattactgactagctacattagngacgagcaggacacgactaagttacgttacgtttcgggacggggtacggaccgtaaaggcctacggaccgtacgagtacgggtaacgacggacccgtaagggcccgtcccgtcccccgtggtacccc

SEQ ID NO: 305911 - DNA, 522 bp, Homo sapiens
  misc_feature: GZ8MTXP02JEQQ2.2.35.D02.1.454.CMB.2.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactntgtctctgtatcaacacacccggcaacgcccccaaactcctcatttangagtcactaagcggccttaggggtccctgactcgcttctctggcctcagtctgcagacgcctcctgaccgtctcgtggctcaagctgagatgagtctagattatacgtgcagctacgatatgcgagcagcagacaagttcgttacgttcggacggtacggaccaacgtctacggaccgtcgttggacaacgacccgaacgcctccgccccgttcggtactacccg

SEQ ID NO: 305912 - DNA, 636 bp, Homo sapiens
  misc_feature: GZ8MTXP02HP7UC.2.35.D02.1.454.CMB.2.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctccngcactggagcagcagtgacgttggcgtttanaactntgtctctgtatacaacaaccgacccggacgaacgaccccaaactcctactatttatgagtcaacgtaacggccggtcccgttaggggtccctggactcgcctctctggccctacgaagtctggcacggaaccggtccctcccgtagacccgttcgtcgtcgggacctaccgaacgtccgtaggaggtaagtggacggtacgttagtaatttaacgttacgtcgacgtacgtcttactagttagtcgacgagacgagtacgagtacgtaagttcggtttacgttacgggacggtaacggaaccgtaacgtcgtaccggtacccgtacggtacggtaccgaaccggacccgtaacggtcccgtacccgtaccccgttacggtacctccg

SEQ ID NO: 305913 - DNA, 537 bp, Homo sapiens
  misc_feature: GZ8MTXP02FTUX9.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggcaacgcccccaaactcctcatttatgagtcactaagcggcccttagggtccctgatcgcttctctgccctcagtctggcagaacgcctcctcgaccgtctcgtcgggcctaccaagctagagactgagctgtatttatactgacagtctacatatgacaggcagcagacaattgttacgtttcggacggagggaccaagcgtacgtaccgtccgtgggtaccaaggtaccccaagggtccctccggacccccgtcgtacctacccg

SEQ ID NO: 305914 - DNA, 518 bp, Homo sapiens
  misc_feature: GZ8MTXP02IC7HO.2.35.D02.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaaccaccccggcgaacgcccccaaactcctcatttangagtcactaagcggccttaggggtccctgatcgcttctctggcctccagtctggcagaacgcctccctgaccgtctcgtggctaccagctgagatgagctgattatactgcagctcatatgcaggcagcagcaatgtactttcggacggtaggaccaagcgtagacccgtcgtcgggtcaacgcccgaacggcctccgcccccgtcggtcctaccg

SEQ ID NO: 305915 - DNA, 525 bp, Homo sapiens
  misc_feature: GZ8MTXP02JO6UO.2.35.D02.1.454.CMB.2.raw
  modified_base (244)..(244): a, c, t, g, unknown or other
  misc_feature (244)..(244): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanactatgtctctggtatcaacaacaccccggcgaacgcccccaaactcctcatttatgagtcactaagcggccctaggggtccctgatcgcttctctggccctcatctgcagacgcctccngaccgtctctggctccaagctagagatgagtctgtattattacngacagcttcatagtgcaggcaagcagcaaattgttactttcgggacggtagggaccaacgcgtacgtacccgtcgtcggtacaacgccgtaaggcctcgcccccgtcggtctacccg

SEQ ID NO: 305916 - DNA, 532 bp, Homo sapiens
  misc_feature: GZ8MTXP02F2LHM.2.35.D02.1.454.CMB.2.raw
  modified_base (431)..(431): a, c, t, g, unknown or other
  misc_feature (431)..(431): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccccggcgaaacgccccccaaaactccctcatttatgaggtcactaagcggcccttaggggtccctgatcgcttctctggcctccaagtctggcacgaacggcctcctgaccgtctctgggctccaagctgaggatgagctgtattattactgcagctnatatgcaggcagcagcaatgtacgtttcggacggtagggaccaagcgtacgaccgtcgtcgggtcaacgcccgaaggccttacgccccctcggtctacccg

SEQ ID NO: 305917 - DNA, 551 bp, Homo sapiens
  misc_feature: GZ8MTXP02HHYIZ.2.35.D02.1.454.CMB.2.raw
  modified_base (438)..(438): a, c, t, g, unknown or other
  misc_feature (438)..(438): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgccccccaaaactccctacacttttatgaaggtcactaaagcggcccttaggggtccctgatcgcttctctggcctccaagtctggcagacgcctccctgaccgtctctgggctcccaaagctgagatgagctgattagttactgcagctacattangacagcagcagctaagtgttacgtttcgggacggacggaccaacgtcgtacgtaccgtccgtcgggtacaacggacccgaacggtcctacccggcccccgttcggtacctccg

SEQ ID NO: 305918 - DNA, 594 bp, Homo sapiens
  misc_feature: GZ8MTXP02ISR1V.2.35.D02.1.454.CMB.2.raw
  modified_base (248)..(248): a, c, t, g, unknown or other
  misc_feature (248)..(248): n is a, c, g, or t
  modified_base (342)..(342): a, c, t, g, unknown or other
  misc_feature (342)..(342): n is a, c, g, or t
  modified_base (370)..(370): a, c, t, g, unknown or other
  misc_feature (370)..(370): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaaccaccccggcgaacgacccccaaacctcctcatttatgagtcactaagcggccttaggggtccctgatcgcttcnctggcctccagtctgcacgacgcctccngaccgtctctggctcaagctgagatgagctgattatactgcagctacgattatcgtacgaggacaggacacgtacgaaagtttcgttaaacgttttcggggaccggggtacgggaaccgaaacggtaccgttacggtacccgttacccggttcggggtaccgtaaccggaccccgaaacggggtcccgtaccggtcccccccgtaccgggttaccttacccccg

SEQ ID NO: 305919 - DNA, 551 bp, Homo sapiens
  misc_feature: GZ8MTXP02IIW9I.2.35.D02.1.454.CMB.2.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (397)..(397): a, c, t, g, unknown or other
  misc_feature (397)..(397): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaggcagcagtgacgttggcgttataactntgtctctggtatcaaacaacaccccggcgaacgcccccaaactcctcatttangagtcactaacgcgtcccgttaggggtccctgactcgcttctctggcctccagtctggcagaaccgctcctgaccgtctcgtgggctcagctgagntgagctgattattactgcagctacatatgcaggcagcagacaagttcgtaacgtttcgggacgggtacgggaccaaaggtcctacggacccggttcgtcggggtaccaacggaccccgaaacggtccgttccgcccccgttacggtcctacccg

SEQ ID NO: 305920 - DNA, 542 bp, Homo sapiens
  misc_feature: GZ8MTXP02IAJT6.2.35.D02.1.454.CMB.2.raw
  modified_base (195)..(195): a, c, t, g, unknown or other
  misc_feature (195)..(195): n is a, c, g, or t
  modified_base (247)..(247): a, c, t, g, unknown or other
  misc_feature (247)..(247): n is a, c, g, or t
  modified_base (421)..(421): a, c, t, g, unknown or other
  misc_feature (421)..(421): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggagcagcagtgacgttggcgttataactntgtctctggtatcaacaacaccccggcaacgcccccaaactcctacatttatgagtcactaagcgccgttagggtccctgatcgcttctctggcctccagtctggcagaacgcctccctgacccgtctctgggctccaagctgagatgagctgattatactgcagctcattagngacgagcagcagactaagttcgttacgtttcgggacggtaacggaccgaacgtcgtacggtaccgtccgtcggtaccgaacggacccgaacggtccgtcccgtcccccgtcggtacctacg

SEQ ID NO: 305921 - DNA, 521 bp, Homo sapiens
  misc_feature: GZ8MTXP02HL71K.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaaacaacaccccggcgaacgcccccaaactcctaccatttangaggtcactaagcggcccttaggggtccctgatcgcttctctggcctccagtctggcagaacgcctcctgaccgtctcgtggctcagctgagatgagctgattatactgcagctcatatgcaggcagcagcaatcgtactttcgggacgtaggacaacgcgtacgaccgtcgtgggtacaacgacccgaaggtcctcgcccccgtcggtactacccg

SEQ ID NO: 305922 - DNA, 611 bp, Homo sapiens
  misc_feature: GZ8MTXP02JA5DY.2.35.D02.1.454.CMB.2.raw
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
  modified_base (451)..(451): a, c, t, g, unknown or other
  misc_feature (451)..(451): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacaccccggcgaacgcccccaaactcctcatttangagtcactaagcgtccgttagggtccctgactcgcttctcgtcggccctccgaagtctggctaacgacggccctcctgacccgttctcgtcgggcctaccaagctaggacgagtggagtctagtaattagttactgactagctacattacgngacgaggacacggcaacgtactaagttcgtttaacgtttcggggacggtaaacggggaacctaaacggtcgtaccggtaacccggttccggtaacggggttccgaaccggaccccgtaaagggtcccttacccggccccccgttacggtcccttaccccg

SEQ ID NO: 305923 - DNA, 522 bp, Homo sapiens
  misc_feature: GZ8MTXP02I5G9J.2.35.D02.1.454.CMB.2.raw
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggngaaagcccccaaaactcctcatttangaggtcactaagcggccttaggggtccctgatcgcttcnctggcctcagtctggcagacgctccngaccgtntctgggctccaagctgaggatcgagctgattatactgcagctcatatgcaggcagcagcaatgtacgttttcggcggtagggaccaaaggctcgaccgtccgtcgggttacaacgcccgaaaagccgtcgcccccgtcggtctacc

SEQ ID NO: 305924 - DNA, 575 bp, Homo sapiens
  misc_feature: GZ8MTXP02GISKG.2.35.D02.1.454.CMB.2.raw
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccggnaacgcccccaaactcctcatttangaggtcactaagcgtccttagggccctgatcgcttctctggcctcaagtctggcagaacgcctcccngaccgtctctgggctccaagctgagatgagctgtattatactgctagctacatatgcgaaggccaaggcaggactaaacgttggtttaaccgttttcggggaccgggttaacggggaacccaaaggtcccgttaggaaccccgttcgtgggggttaccaacggccccgaaaggggtccccttcgaccccccgttacggttcctaacccg

SEQ ID NO: 305925 - DNA, 520 bp, Homo sapiens
  misc_feature: GZ8MTXP02JGT48.2.35.D02.1.454.CMB.2.raw
  modified_base (242)..(242): a, c, t, g, unknown or other
  misc_feature (242)..(242): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctgtatcaacacaccccggcgaacgccccaaactcctcatttangagtcactaagcgtccttagggtccctgactcgcttctctgcctcagtctggcagaacgcctcctgaccgtctcgtggcctccaagctgagatgagctgattatactgcagctacatatgacgaggcagacagctaaagtgttacgtttcgggacggacggaccaacgtcctacgacccgtcgtgggtcaacgcccgaaggcctacgcccccgtcggactacccg

SEQ ID NO: 305926 - DNA, 521 bp, Homo sapiens
  misc_feature: GZ8MTXP02JF62F.2.35.D02.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanaactntgtctcctgtatcaacaacaccccggcgaacgccccccaaactcctaccatttangaggtcaactaagcggcccttaggggtccctgatcgcttcnctggcctcagtctggcagacgcctcctgaccgtnctgggctccaagctgagatgagctgattatactgcagctanatangacagcagcagactagttcgttacgttcgggacggacggaccgagcgtacgaccgtcgtcggacaacgccgacggcctaccgccccgtcggactacg

SEQ ID NO: 305927 - DNA, 518 bp, Homo sapiens
  misc_feature: GZ8MTXP02FNJ8M.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaacaccccggcgaacgcccccaaactcctcatttatgaggtcactaagcggcccttaggggtccctgatcgcttctctggcctccaagtctggcagaacggcctccctgaccgtctctgggcctccaagctgagatgagctgattattactgcagctcatatgcaggcagcagcaatgtactttcggcggtaggaccaagctcggacccgtcgtgggtcaacgtcccaaggcctcgccccctcggtctaccg

SEQ ID NO: 305928 - DNA, 520 bp, Homo sapiens
  misc_feature: GZ8MTXP02FVFR2.2.35.D02.1.454.CMB.2.raw
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggcaacgcccccaaactcctacatttangaggtcactaagcggccttagggccctgatcgcttctctggcctcagtctgcagacgcctccngaccgtctctggctcagctgagntgagctgtattatactgcagctcatatgcagcagcagcaatcgtacgtttcggacggtaggaccaacggtctacggaccgttccgtgggtacaacgacccgaaacggtccaccgtcccccgtcggtacctacccg

SEQ ID NO: 305929 - DNA, 521 bp, Homo sapiens
  misc_feature: GZ8MTXP02IL22P.2.35.D02.1.454.CMB.2.raw
  modified_base (405)..(405): a, c, t, g, unknown or other
  misc_feature (405)..(405): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaaacaacaccccggcgaaacgccccccaaaactccctcatttatgaggtcaactaagcggcccttaggggtcccctgatcgcttctctggcctccagtctggcagaacgcctccctgaccgtctcgtggctcccaagctgagntgagctgattattactgcagtctacattatgcgagcagcagcattgtactttcggacgtagggaccaagctcgaccgtcgtggtcaagcccgaaggcctcgccccctggtcctacg

SEQ ID NO: 305930 - DNA, 517 bp, Homo sapiens
  misc_feature: GZ8MTXP02GV6XG.2.35.D02.1.454.CMB.2.raw
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaacgcccccaaactcctcatttangaggtcactaagcggccttaggggtccctgatcgcttcnctggcctcagtctggcagaacgcctccngaccgtctctgggctccaagctgagatgagctgattatactgcagctacatatgcgaggcagcagctaatgttacgtttcggacggtagggaccaagctacgaccgtcgtggtcaacgacccgaaggcctcggcccctcggtctaccg

SEQ ID NO: 305931 - DNA, 556 bp, Homo sapiens
  misc_feature: GZ8MTXP02GK9YU.2.35.D02.1.454.CMB.2.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgcccccaaactcctcatttangaggtcactaagcggtccttaggggtccctgactcgcttctctggcctccagtctggcagacggcctccngacctctcgtggctcaagctgagatgagctgtattattacgngcagctacatatgacaggcagcagcaattgtacgtttcgggacggtacgggaccgaaacggtccgtacggacccgttccgtgggttaccgaacggccccgaaacggcccgttccggcccccgttccgggtaccctttaacccg

SEQ ID NO: 305932 - DNA, 511 bp, Homo sapiens
  misc_feature: GZ8MTXP02GVA5I.2.35.D02.1.454.CMB.2.raw
  modified_base (301)..(301): a, c, t, g, unknown or other
  misc_feature (301)..(301): n is a, c, g, or t
  modified_base (477)..(477): a, c, t, g, unknown or other
  misc_feature (477)..(477): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaaacaacaccccggcaacgcccccaaactcctcatttangagtcactaagcgccttagggtccctgatcgcttctctgcctcagtctggcagaacggcctcctgacccgtctcgtgggcctccaaagctgaggatgaggctgattattactgcagctacatatgcaggcagcagcaatgtactttcggcggtacggacaacgctacgaccgtcgnggtcaacgcccaaggcctcgcccctggcctaccg

SEQ ID NO: 305933 - DNA, 551 bp, Homo sapiens
  misc_feature: GZ8MTXP02JPRHA.2.35.D02.1.454.CMB.2.raw
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttatactatgtctctggtatcaacaacaccccggcgaacgcccccaaactcctcatttangaggtcactaagcggcccttaggggtccctgatcgcttctctggccctcagtctggcagaacggcctcccgtgacccgtctcgtcgggctaccaagcctggaggatggagctagatttaattacgngcatctatatagcgacgagcagacagactaagttcgttacgttcgggacgggacggacacgtcgtacgtacccgtcggtcggaccaacggacccgaacggcctcccgtccccgtacgtacctacg

SEQ ID NO: 305934 - DNA, 611 bp, Homo sapiens
  misc_feature: GZ8MTXP02J1597.2.35.D02.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacacccggcaacgcccccaaactcctnatttangacgtcactaacggccggcccgttacggggtccctgactcgcttctctggccctccagtcgtggcacggaaccggccctcccgtgacccgtcgtcgtcgggcctccgaagcgtaggaggatggagctgtaatttattacgtgctagctcgaatgtgcgaacggcaggaccaggtactaaggtttcgttaacgttttccggggacgggtaacgggacccgaaacggtccgtacggtaacccggttccggtacggggttaccaaccggtaccccgaacgggtccctccggccccccgtttacggccctttaccccg

SEQ ID NO: 305935 - DNA, 530 bp, Homo sapiens
  misc_feature: GZ8MTXP02G999B.2.35.D02.1.454.CMB.2.raw
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttatactatgtctctgtatcaacaacaccccggcaacgcccccaaactcctacatttangagtcactaagcggtccttagggtccctgactcgcttctctggccctcagtctgcagacgcctccgtgaccgtctcgtcgggcctaccgaagctaggagatggaggtctgatttatactgcagctacatangcgaggcagcagactaagttcgtacgtttcggacggacggaccagtcgtacgacccgtcgtgggtacaacgccgaaggcctccgcccctcggacctaccg

SEQ ID NO: 305936 - DNA, 715 bp, Homo sapiens
  misc_feature: GZ8MTXP02JP1PT.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctgtatcaacaaccaccccggacgaaccgacccccaaactcctactatttangtacggtcaacgtaacgccggtcccgttacggggtccctgactcgtcttctcgtcggccctacgaagttctacggcaacggaaccggtccctcccgtacgtaccccggttccttccggtcggggtccctaccgaaacgtccgttaggaacgggtatacgggaacgggtcttaggtaattttaacgttaaccgtcgtacccgtaagtccttaccgtaattacgtcggacgaagggacaacggaccgaagtaacctaaaggtttacggtttaacccgtttaccgggggacggggtaaccggggaaaccgtaaacggtccgttaaccgggtaccccggtcggttaccggggtaccaacccggacccgtaaaccgggtcccgtacccggtccccccggttacggtccctacccg

SEQ ID NO: 305937 - DNA, 558 bp, Homo sapiens
  misc_feature: GZ8MTXP02GHNC1.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggcgaacgcccccaaactcctcatttangagtcactaagcggtccttaggggtccctgactcgcttctctgcctcagtctggcagaacgcctcctcgaccgtctcgtcggctaccagctgagatgagctgattatactgctagctacatatgacgaggcagcagactaattcggttacgtttcggacgggtaacgtaaccgaacgtacgtacggtaccggtaccgttcggtacgaaccgacccgaaacggtccgtccggtccccccgtacggtccctacccg

SEQ ID NO: 305938 - DNA, 522 bp, Homo sapiens
  misc_feature: GZ8MTXP02JU0U8.2.35.D02.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (402)..(402): a, c, t, g, unknown or other
  misc_feature (402)..(402): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanaactatgtctcctggtatcaacaacaccccggcgaacgcccccaaactcctcatttangagtcactaagcgccttagggtccctgactcgcttctctggcctcaagtctggcagaacggcctcctgacccgtctcgtcgggctcccgaagctggaggntcgaggctgaatttatactgcagctcgatatgcaggcagcagcaatcgtacttcgggacgtaggaccaagctcggaccgtcgtgggtacaacgccaaggcctcgccccctggtcctaccg

SEQ ID NO: 305939 - DNA, 528 bp, Homo sapiens
  misc_feature: GZ8MTXP02FWT1K.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaaacaacaccccggcgaacgccccccaaactcctcatttatgagtcactaagcggcccttagggtccctgatcgctctctggcctcagtctggcagaacgcctcctgaccgtctcgtggctcaagctgagatgagctgattattactgcagctcatatgacaggcagcagcaatagtactttcgggcggtagggaccaaagtctacgaccgttacagtcgggtccaacggacccgtaaacggcctacggccccccgtacggtccc

SEQ ID NO: 305940 - DNA, 525 bp, Homo sapiens
  misc_feature: GZ8MTXP02JUBA0.2.35.D02.1.454.CMB.2.raw
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcactggagcagcagtgacgttggcgttanaactatgtctctgtatcaacacaccccggngaacgcccccaaactcctactatttatgaggtcactaagcggcccttaggggtccctgactcgcttctctggcctccagtcnggcagaacgcctccgtcgaccgtcncgtgggctccgaagctgagatgaggctgattactatgcagctcatatganagcancagcaagtgttacgttcggacggaggacaagcgtacgaccgtcgtggtaccaacgacccgaacggcttccggcccccgtcggtctaccg

SEQ ID NO: 305941 - DNA, 536 bp, Homo sapiens
  misc_feature: GZ8MTXP02GQD00.2.35.D02.1.454.CMB.2.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (352)..(352): a, c, t, g, unknown or other
  misc_feature (352)..(352): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggngaacgcccccaaactcctcatttangagtcactaagcgtcccttaggggccctgatcgtcttctctggcctcagtcnggcagacgcctcctgaccgtctctgggcctccaagctgagatgagctgattatacngtcagcctnatatcgcgaggccagcagactaagttcgttacgtttcgggacgggtacggaaccgaagccgtacgacccgtccgtggtaccaacgcccgaacggccgtccgccccgtcggtacctcccg

SEQ ID NO: 305942 - DNA, 524 bp, Homo sapiens
  misc_feature: GZ8MTXP02IGPN2.2.35.D02.1.454.CMB.2.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (420)..(420): a, c, t, g, unknown or other
  misc_feature (420)..(420): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccgnaacgccccaaactcctcatttangagtcactaagcggccgttagggtccctgactcgcttctctggcctccaagtctggcagacgcctcctgaccgtctcgtgggctccaagtctgagatcggagctgattatactgcagctacattangacgagcgagcagacaagttgttaacgtttcggacggtaggaccaagtccgtagaccgtcgtgggtacaacgcccgaagtccgtcgtcccccgtacgcctaccg

SEQ ID NO: 305943 - DNA, 547 bp, Homo sapiens
  misc_feature: GZ8MTXP02JOKID.2.35.D02.1.454.CMB.2.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaggcagcagtgacgttggcggttanaactntgtctcctggtatcaacaacaccccggcgaacgcccccaaaactcctacatttangaggtcaactaagccggtcccttaggggtcccctgactcgtcttctctggccctccaagtctggcagacgcctccngaccgtctcgtgggcctccaagctggagntggagctgatttatctgctagctacatatgcagcagcagcaattgtaacgtttcgggacggacgggtaccaaggctacggacccgtccgtgggtccaacggacccgaaggtcctccgcccccgtcggtactacccg

SEQ ID NO: 305944 - DNA, 574 bp, Homo sapiens
  misc_feature: GZ8MTXP02G04IS.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggagcagcagtgacgttggcgttaanaactntgtctctgtatcaacaaccaccccggcaacgcccccaaaactcctactaatttatgaaggtcaacgtaagccggtcccttaggggtccctggatcgcttctctggcctcaagtctggcagaacgcctccgtgaccgtctcgtggcctacaagctgagatgaggtctgtaattattacgngactagtctatatagtagacgagacagactaacgactaagttcgttaacgtttcgggacggaacggaccaacggtcgtaccggtacccggttaccgtagggtaccaacgacccgaacggtccctcccgtcccccgtcgtacctaccg

SEQ ID NO: 305945 - DNA, 575 bp, Homo sapiens
  misc_feature: GZ8MTXP02ILMLL.2.35.D02.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggagcagcagtgacgttggcgttataactntgtctctgtatcaacacacccgcgaacgacccccaaatcctacatttangagtcactaagcgaccttagggtccctgatcgtcttctctcggcctaccatctggcagaaccgcctcctgaccgttcncgtggctcgagctgagatgagctgtattattacngcagtctacatatcgacgaggccagtacagactaaatttgttaaccgttttcgggacgggtacgggacccaaaggtcctacggtaccccggttccgttacgggtaccaaccggaccccgaaacgggtccccgttaccggccccccgttacgggttacccttaaccccg

SEQ ID NO: 305946 - DNA, 548 bp, Homo sapiens
  misc_feature: GZ8MTXP02HL945.2.35.D02.1.454.CMB.2.raw
  modified_base (241)..(241): a, c, t, g, unknown or other
  misc_feature (241)..(241): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttanaactatgtctcctggtatcaacaacaccccggacaaacgcccccaaaactcctacaatttatagagtcaactaaagccgacccgttaggggtccctgatcgcttctctgcctccaagtctgcagaacgcctcctancctcnctggctccaagtcngagagngagntagtatatactgcagtactatatagtagacgagacgacgacgagacgtaagtacgttacgttacggtacggacggacgaacgacgtacgtaccgtcgtcggtacgaacgaccgacgaccgtccgtcccgtccgtaccgtccg

SEQ ID NO: 305947 - DNA, 715 bp, Homo sapiens
  misc_feature: GZ8MTXP02H2MTN.2.35.D02.1.454.CMB.2.raw
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcatggagcagcagtgacgttggcgttanactntgtctctgtatcaacacacccggcgaacgccccaaactcctacatttangagtcactaagcgtccttagggtccctgactcgcttctctgcctccaagtctggcaacgaacgcctcccgtagaccccgttctaccgttcggggccttacccgaaacgcctaggtacgggtagttacggaacgggtcgttacgtaagttttaaactttaacccgttggaccgtaaggtccttacctaattacgttacggaccgtacgggccgaaacggccgaaacgggtactaaaacgtttacgggtttaaccgtttttaccgggggaccggggtaaacgggggtaacccgtaaaacggtacccggttacggtaacccccgggttcccggttacggggttacccgaaaccgggtacccccgaaaacggggtccccgttacccgggtacccccccgttcggggttaaccccttacccccgg

SEQ ID NO: 305948 - DNA, 526 bp, Homo sapiens
  misc_feature: GZ8MTXP02ID9I9.2.35.D02.1.454.CMB.2.raw
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggcgaacgccccaaactcctcatttangagtcactaagcgtccgttagggtccctgactcgcttctctgcctccagtctggcagacgcctcctgaccgtctcgtggctccaagcngagntggagtctagtattattacgtgctagtctacattatgcgaggcagcagactaattgtacgtttcggacggaggaccagtctacggacccgtcgtggtccaacggccgaacggtcctaccgcccccgtcggtcctaccg

SEQ ID NO: 305949 - DNA, 533 bp, Homo sapiens
  misc_feature: GZ8MTXP02H5ZWM.2.35.D02.1.454.CMB.2.raw
  modified_base (250)..(250): a, c, t, g, unknown or other
  misc_feature (250)..(250): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggaggcagcagtgacgttggcgttataactntgtctcctggtatcaacaacaccccggcgaacgccccccaaactccctcatttatgaggtcaactaagccggcccttaggggtccctgatcgcttcnctggcctccagtcnggcagacgcctccngacctnctggctcagctgagatgagctgattatactgcagtctcatatgcaggcagcagcaattgtacgtttcgggcggtacggaacctaggctacgtacccgtcgtgggtaccaacggtcccgaaacggcctccgcccccgttcggtaccctacccg

SEQ ID NO: 305950 - DNA, 558 bp, Homo sapiens
  misc_feature: GZ8MTXP02IUQOA.2.35.D02.1.454.CMB.2.raw
  modified_base (250)..(250): a, c, t, g, unknown or other
  misc_feature (250)..(250): n is a, c, g, or t
  modified_base (415)..(415): a, c, t, g, unknown or other
  misc_feature (415)..(415): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactntgtctcctggtatcaacaacaccccggcgaacgcccccaaactcctcatttatgagtcactaagcggccttaggggtccctgatcgcttctctgcctcagtctggcagaccgcctcctgaccgtctcgtggctcagctgagatgagctgattatactgcagctanatatgacaggcagcagactaagttcgttacgtttcggggacggacgggtaaccacggtaccgttacggacccggttccggtaggggttacccaacgggtaccccgaaggggtccctaccggccccccgttcggtacctacccg

SEQ ID NO: 305951 - DNA, 502 bp, Homo sapiens
  misc_feature: GZ8MTXP02I749D.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (465)..(465): a, c, t, g, unknown or other
  misc_feature (465)..(465): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctcctggtatcaacaacaccccggcgaacgcccccaaaactccctcatttangaggtcactaagcggccttaggggtccctgatcgcttctctggcctcaagtctggcagaacgcctcctgaccgtcnctgggctccaagctgagatgagctgattatactgcagctcatatgcagcagcagcaatgtacttcggcgagggcaagcagaccgtcngggtacaagcccgaagctacgcccctacggtctaccg

SEQ ID NO: 305952 - DNA, 516 bp, Homo sapiens
  misc_feature: GZ8MTXP02IQPZJ.2.35.D02.1.454.CMB.2.raw
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggcggttataactatgtctcctggtatcaacacaccccggcgaacgcccccaaactcctcatttangaggtcactaagcgccttaggggtccctgatcgcttctctggcctccagtctgcagacgcctccngaccgtctctggctcagctgagatgagctgattattactgcagctcatatgcaggcagcagctaagttgtactttcgggacggtaggaccaaggtctaggacccgttcgtcggtacgaacgcccgaagggcctcgccccctggtacctacg

SEQ ID NO: 305953 - DNA, 609 bp, Homo sapiens
  misc_feature: GZ8MTXP02HVRQJ.2.35.D02.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatcctcctgcacgtggagcagcagtgacgttggcgttanaactntgtctcctgtatcaacacaccccggacaacgccccaaactcctactatttatgtacgtacaacgtaagccggtccgttacggggtccctgtactcgcttctctggccctacagtctggcagaccgtccctccgtgaccgtctcgtcgggacctccgaagctaggagctggagtctagtattactactgcagctactatagtcgacgaggcaggcaagacgtaaagttcgtttaacgtttccgggacgggtaaccggaaccgtaaacgtaccgtccggtaacccgttcccggtacgggtacccgaaccggaccccgtaacggtcccgtacccggtccccccgtacggttacccttccccg

SEQ ID NO: 305954 - DNA, 572 bp, Homo sapiens
  misc_feature: GZ8MTXP02GNJ8A.2.35.D02.1.454.CMB.2.raw
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggcaacgcccccaaactcctcatttangagtcactaagcggtcccttagggtccctgactcgcttctctggcctcagtctgcagacgcctccngaccgtctctggctcagctgagntgagctgattatacngcagctcatangcgaggcagcagactaagttcgtttaacgtttcgggacgggtaacgggaacccgtaaacggtccgtacggtaccccgtccggttacgggggtacctaaccgggtaccccgaaacggggtccccgtacccggtaccccccggttcgggttaccctaccccgg

SEQ ID NO: 305955 - DNA, 557 bp, Homo sapiens
  misc_feature: GZ8MTXP02H7JIF.2.35.D02.1.454.CMB.2.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctcgcgtccggtctcctggacngtcagtcaccatctcctgcactggagcagcagtgacgttggcgttanaactatgtctcctggtatcaacaaccaccccggcgaacgccccaaactcctcattatgagtcactaagcggtccttagggtccctgatcgcttctcgtgcctcagtctggcagaaccggcctcctgacccgtctcncggctccaagctgagntgagctgattactactgcagctacattangacaggnacgcagctaaagtcgtttacgtttacgggacggtaacgggtacccaaagtccgtacggtaacccgtccgtcggggttaccaaccggacccgaacggtcgtacccgcccccgttacggtccctacccg

SEQ ID NO: 305956 - DNA, 543 bp, Homo sapiens
  misc_feature: GZ8MTXP02I8WAV.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaacaacaccccggcgaaacgcccccaaactcctcatttangagtcactaagcggccttaggggtccctgactcgcttctctggcctccagtctggcagacgcctcctgaccgtctcgtggcctcaagctgagatgagctgtattattactgcagctcattatgcgagcagcagtacaagttgtacgtttcgggacggtagggaacccaaggtcctacggacccgttccgtggggtcaacggaccccgaaggtcccgtccgcccccgttcggtcctacccg

SEQ ID NO: 305957 - DNA, 524 bp, Homo sapiens
  misc_feature: GZ8MTXP02G6ZWH.2.35.D02.1.454.CMB.2.raw
  modified_base (248)..(248): a, c, t, g, unknown or other
  misc_feature (248)..(248): n is a, c, g, or t
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgcccccaaactcctacatttatgaggtcactaagcggcccttaggggtccctgactcgcttctctggcctcagtctggcagacgcctcccngaccgtctctggctccaagctgagatgagctgtattatactgcagctcatangcagcagcagcaatcgtacgtttcggacggtacgggaccaaagcgtacgaccgtccgtgggtccaacggacccgaacggcctccggcccctcggtactccg

SEQ ID NO: 305958 - DNA, 523 bp, Homo sapiens
  misc_feature: GZ8MTXP02GLU9U.2.35.D02.1.454.CMB.2.raw
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaaacaacaccccggcaacgcccccaaactcctacatttangagtcactaagcggccttagggtccctgatcgcttctctggcctccagtctgcagacgcctccngacctntcgtggctccagctgagatgagctgattattacngcagtctatatatgacgagcagcagactaagttgttacgtttcggacggtacggacacgtcgtacgaccgtcgtggtacgaacgacccgtaacggcctccgccccgtcggtacctacg

SEQ ID NO: 305959 - DNA, 553 bp, Homo sapiens
  misc_feature: GZ8MTXP02JAVMQ.2.35.D02.1.454.CMB.2.raw
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
  modified_base (409)..(409): a, c, t, g, unknown or other
  misc_feature (409)..(409): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgcccccaaactcctcatttangagtcactaagcgccttagggtccctgactcgcttctctgcctcagtctgcagaacgcctcctgacctctctggcctacaagctgacgatgaggctgtaattattacgngcagtctacatagtcgacgagacgagacgacgactagttagttacgttacgggacgggtaacggaccgtacgtacgtacggaccgttcgtcggtaccgaaccggacccgacggtcccgtcccggtccccgttacggtacctccg

SEQ ID NO: 305960 - DNA, 544 bp, Homo sapiens
  misc_feature: GZ8MTXP02IP3IA.2.35.D02.1.454.CMB.2.raw
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctcgcgtccgggtctcctggacagtcagtcacatctcctgcactggagcagcagtgacgttggcgttataactatgtctctgtatcaacaacacccgcgaacgcccccaaatcctacatttangagtcactaagcgtccttacgggtccctgatcgcttctctggcctccagtctggcagaccgcctccngaccgtctcgtgggcctaccaagtctgacgatgagctagatttattacngacagtctacatntgacgagcagacgagactaagttacgttacgtttacgggacggtaacggaccacgtcgtacggtaccgtacgtcggtacaaccgaccgaacggtccgtacccgtccccgttacgtactacc

SEQ ID NO: 305961 - DNA, 579 bp, Homo sapiens
  misc_feature: GZ8MTXP02HU9A2.2.35.D02.1.454.CMB.2.raw
  modified_base (249)..(249): a, c, t, g, unknown or other
  misc_feature (249)..(249): n is a, c, g, or t
  modified_base (310)..(310): a, c, t, g, unknown or other
  misc_feature (310)..(310): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggagcagcagtgacgttggcgttataactntgtctctgtatcaacaaccgaccccggacgaaccgacccccaaactccctactaattttangtacggtccaacgtaacggccggtaccccgttacggggtccctgactcgctttctctcggccctcagtctgcacgacgcctccngaccgtctcgtcggctcagctgagntgagctagtattatacgtgacagtctatacttagtcgcgaggacagacagactaagttcgttacgtttacggacggtacgggactaacggtcgttacggaccgttcgtacggtaccaacggaccgaacggtcccgtaccgtcccccgtcggtaccctccg

SEQ ID NO: 305962 - DNA, 544 bp, Homo sapiens
  misc_feature: GZ8MTXP02HQIV2.2.35.D02.1.454.CMB.2.raw
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (439)..(439): a, c, t, g, unknown or other
  misc_feature (439)..(439): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaaacaacaccccggcaacgccccccaaactcctacatttangagtcaactaagccggtcccgttaggggtccctgactcgctttctcgtggccctaccagtctggcaggaaccgcctccngaccgtctcgtgggctccagctgagatgagctgatttatactgcagtctcattagngacgagcagcagactaagttcgttacgtttcgggacggtacggactacgcgtacgccgtcgtcggacgaacgcccgaacggtcctccgtaccccgtcgtacctcg

SEQ ID NO: 305963 - DNA, 659 bp, Homo sapiens
  misc_feature: GZ8MTXP02GZB4L.2.35.D02.1.454.CMB.2.raw
  modified_base (312)..(312): a, c, t, g, unknown or other
  misc_feature (312)..(312): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttataactatgtcctcgtggtactacaaacaccgaccccggacgaacccgacccccaaatcctatatttagngtacggtcaacgtacggccggtaccggttacgggtccctgactccgctttcgtcgtcgccctacgacgtcgtcggacaacggtacccgtccctacccgtacggtacccgttctacgggtcggaccctaccggtaacgccgtaggaggacgtagggagtctaggttactttacgtaccgtgactagtctacgattacgacgacgaggacacgcgtaacgtacgtaacgtttcggtttaccggttcgggggaacggtaccgggaaactcggttacgccggttacccggtcggtacggtaccgccgacccgtacggtcccgtacccgtcccccgttagacccgtttcccg

SEQ ID NO: 305964 - DNA, 596 bp, Homo sapiens
  misc_feature: GZ8MTXP02HVIKO.2.35.D02.1.454.CMB.2.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctctggtatcaacaacacccggacaacgccccaaactcctactatttangagtcacgtaagcggtccgttacggggtccctgactcgcttctctggccctccaagtctggacacggaaccggccctccgtcgaccgtccgtcgtcggggctccgaacgtcgtaggacggataggacggtctaggtaatttacgttacgtcgacacgtcttactaattagtacgacgaggcacgacagactaagttcgttacgtttcgggacggtaacggacaacgtcgtacgaccgtccgtacggtacgaaccgtaccgaacggtccgtaccgtcccccgtacggtacctacccg

SEQ ID NO: 305965 - DNA, 571 bp, Homo sapiens
  misc_feature: GZ8MTXP02FWM07.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctggtatcaacaacaccccggnaacgcccccaaactcctcatttangagtcactaagcggcccttaggggtccctgatcgcttctctggcccctccaagtctggcacggaaccggccctcccgtgacccgtctcgtgggcctccaaagtcgtaggaggtatggaggtctagtaatttaacttactcgctagctacatatgcaggcagacagactaatagttacgtttcgggacggtacgggaacctaacggctacggtacccgtccgtgggtaccaacggcccgaacggtcctcccggcccccgtcggtacctacccg

SEQ ID NO: 305966 - DNA, 528 bp, Homo sapiens
  misc_feature: GZ8MTXP02FZWZ7.2.35.D02.1.454.CMB.2.raw
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacacaccccggcaacgccccaaactcctcatttangagtcactaagcggtcccttaggggtccctgactcgtctctctgcctcagtctgcagacgcctccngaccgtctcgtggctcagctgagatgagctgtattatactgcagctcatatgacagcagcagctaatgttacgtttcggacggtacgggaacctaaggcctacggtacccgtcgtcggtaccaacggacccgaacggtcctccggtcccccgtcggtcctacccg

SEQ ID NO: 305967 - DNA, 525 bp, Homo sapiens
  misc_feature: GZ8MTXP02FYMPA.2.35.D02.1.454.CMB.2.raw
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttanaactatgtctcctggtatcaaacacaccccggngaacgcccccaaatcctnatttangaggtcactaagcggccttaggggccctgatcgcttcnctggcctcagtctggcagacgcctcctgaccgtctctgggctcagctgaggatgagctgtacttatactgctagctcatatgacgaggcagctagcaagtcgttacgtttcggacggtaggaccaagcgtacgaccgtcgtcgggtcaagtccccgaaggccgtccgtccccgtcggtactaccg

SEQ ID NO: 305968 - DNA, 526 bp, Homo sapiens
  misc_feature: GZ8MTXP02JL8H5.2.35.D02.1.454.CMB.2.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctcctggtatcaacaaacaccccggcgaaagcccccaaaactcctaccatttangaggtcactaagcgcccttaggggtccctgatcgcttcnctggcctcaagtctggcagaacgcctcctgaccgtcnctgggctccgaagctgagatgagctgattatactgcagctcattangcagcagcagctagtagtacgttcggtacggacggacgaacgacgtacgtaccgtccgtcggtacgaacgaccgacgacgtccgtcccgtccgtcgtacg

SEQ ID NO: 305969 - DNA, 591 bp, Homo sapiens
  misc_feature: GZ8MTXP02J2WKE.2.35.D02.1.454.CMB.2.raw
  modified_base (555)..(555): a, c, t, g, unknown or other
  misc_feature (555)..(555): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaacacacccgcgaacgccccaaactcctcatttatgagtcactaagcggtccgttacggggtccctgtactcgtcttctctcggcctaccaagtcgtggacacggaaccggccctacccgtcgaccgtcgtccgtcgggtacctcccgaagtccgtaggaggtagtaggaggtctagtaactttattacgtcgcacgtctacatgtgaccgaaggcaggaccaaggtctaaagttcgttaaccgtttcgggacgggacggaccaacggtctacggtacccgtcggttcggaccnccggaccgacggtcctccgccccgttcggactcccg

SEQ ID NO: 305970 - DNA, 631 bp, Homo sapiens
  misc_feature: GZ8MTXP02FMMGA.2.35.D02.1.454.CMB.2.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (441)..(441): a, c, t, g, unknown or other
  misc_feature (441)..(441): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaaacaacaccccggcgaacgcccccaaactcctcatttangaggtcactaagcggcccttaggggtccctgatcgcttntctggccctccaagtctggcacgaacgggccctacccgtgacccgttctcgtgggcctaccgaaagctggaggatggaggtctggtaatttatttacgngacagtctatatagtcggacgacgacgacgacgaacgtaacgttaacgttacggtttaccggttacggggaacggggtaaaccggaaccgtaaccggtccgttacccggtacccggttacgggtacggaccgaaccggtaacccggtaccggtccccgtaccccggtaccccggtaccgtaccgtacccg

SEQ ID NO: 305971 - DNA, 590 bp, Homo sapiens
  misc_feature: GZ8MTXP02JSR4Z.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaaccaccccggcgaacgcccccaaactcctactatttatgacggtacaactaagccggtcccgttaggggtcccctgactcgctttctcgtggccctccaagtctggcagaaccggcctcccgtgacccgtctcgtcgggctaccaagctgagatgaggctgattatactgcagctcatatgacgaggcagcagactaagttcggttaacgtttcgggacgggaacgggaaccaacggtccgtacggtacccgtaccggtcggggtaccaacggtaccccgaaacgggtccgtacccggtccccccgttacggtacccgttacccg

SEQ ID NO: 305972 - DNA, 544 bp, Homo sapiens
  misc_feature: GZ8MTXP02G5JPB.2.35.D02.1.454.CMB.2.raw
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctggtatcaacaaccgaccccggcgaacgacccccaaactcctacatttatgaggtcactaagcggtccttaggggtccctgatcgtcttctctggcctccgaagtctgcagaacgcctcctgaccgtctcgtggctccagctgagntgagctgattatactgcagctanatgngacgagcagacgagactagtacgttacgttacgggacggacggaccacggtcgtacggtaccgtcgtacggtaccaacggtacccgacggtccctacccgtcccccgttcgtactaccg

SEQ ID NO: 305973 - DNA, 572 bp, Homo sapiens
  misc_feature: GZ8MTXP02I0L9I.2.35.D02.1.454.CMB.2.raw
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (405)..(405): a, c, t, g, unknown or other
  misc_feature (405)..(405): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttataactntgtctctgtatcaaacaaccacccggacgaacgacccccaaactcctcatttangagtcactaagccggtccgttacggggtccctgactccgtcttcctcgtcggccctccgaagtctggcagaccgcctcctgaccgtctcgtggctcagctgagntgagctgtattattactgacagtctctattagtcgacgaagcgagcgagtactaagttcgttacgtttcgggacggtacggaccgaaacgtcgtaacggccgttaccggtcggtacgaaccgtacccggaaacggtcccgtacccggtccccgttcggtccttaccg

SEQ ID NO: 305974 - DNA, 499 bp, Homo sapiens
  misc_feature: GZ8MTXP02F5804.2.35.D02.1.454.CMB.2.raw
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (465)..(465): a, c, t, g, unknown or other
  misc_feature (465)..(465): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcgaacgcccccaaactcctcatttangagtcactaagcggcccttagggtccctgatcgcttctctggcctcagtctgcagacgcctccngaccgtctctgggcctcaagctgagatgagctgattattactgcagctcatatgcagcagcagcaatgtactttcggcggaggaccagctacgaccgtcgnggtcaagcccgaagcctcgcccctcggtctaccg

SEQ ID NO: 305975 - DNA, 550 bp, Homo sapiens
  misc_feature: GZ8MTXP02HBG91.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctcctgtatcaacaacaccccgngaacgccccaaactcctacatttangaggtcactaagcgtccgttagggtcctgatcgcttctctggccctaccaagtcgtaggcagaaccggcctcccgtgaccgtctcgtcggctaccaagctaggagagtgaggtctgactttagtacgngnatctanatancgacgagcagacagtactaagttacgttacgttcggacggacggacgaacgcgtacgtaccgtcgtcggacgaaccgaccgacggtcctaccgtcccgttacgtacctccg

SEQ ID NO: 305976 - DNA, 738 bp, Homo sapiens
  misc_feature: GZ8MTXP02G4XK5.2.35.D02.1.454.CMB.2.raw
  modified_base (243)..(243): a, c, t, g, unknown or other
  misc_feature (243)..(243): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctggtatcaaacaaccaccccggacgaaccgaccccccaaaactccctacctattttatacggaggtaccaacgttaaacggccgggtaccccgtttaacgggggtccccctaggtactccggtctttcctccgttcgggtccccttacccgtaaagttccgtacgggaccaaacggtaaacccgggtcccccttccccgtacggtaacccccgttccgtaccgttacgggggcccttacccgaaacggtccgttagggaacggtaagttcggaacgggtacttaggtaacttttaacgttaaccgttcgaccgtaagtcctaaccgtaattaagtcggacgacgggacacggacaaggtactaaagtttcggttaacgttttaccggggacggtaaacggggaccaaacggtcgtaccgggtacccgtccgttgggtaccaacggacccgtaacggcctaccggcccccgttcggtaccctaccg

SEQ ID NO: 305977 - DNA, 596 bp, Homo sapiens
  misc_feature: GZ8MTXP02IZ3SV.2.35.D02.1.454.CMB.2.raw
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaaccaccccggcgaaacgaccccccaaactcctacatttangtaggtcaacgtaagccggtccgttacggggtccctgactcgctttcnctcgcctccagtctgcagaccgcctcctgccgtctcgtcggctcgaagctgagatgagtctagtattatcgtagcacgtctactaatgtcgacgacggacacgcacgtactaagtttacgttacgttttccggggacggggtaacgggaacctaacggtcgtccggtaaccggttccgtcggggtaccaacggacccgtaacgggtccctccggtcccccgttacggtacctttacccg

SEQ ID NO: 305978 - DNA, 693 bp, Homo sapiens
  misc_feature: GZ8MTXP02G16IA.2.35.D02.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacggttggcgttanaactntgtctctggtatcaacacgacccggcgaacgcccccaaactcctactatttatgacggtacaactaacggccggtacccgttaggggtccctgactcgcttctcgtggccctaccagtctggcacgaaccggccctccgtcgacccgttctcgtcgggcctacccgaaagtccgtaggaacggtaagtggaacggtcgtaggtaactttaacgttacgtacgacgtacggtaccttacaagtttacgacggacgaacgggcctaaggaccaacggtaccttaaagtttacggtttaccggttttaccgggggacggggtaaacggggaccctaaacgggtccgttacggtaccccggttccggtttacgggggtaccgaaccggacccccggtaaacgggtccccgtacccggtaccccccgttccgggtacctttaccccgg

SEQ ID NO: 305979 - DNA, 528 bp, Homo sapiens
  misc_feature: GZ8MTXP02GVW29.2.35.D02.1.454.CMB.2.raw
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcgaacgcccccaaatcctacatttangagtcactaagcggccttaggggtccctgactcgcttctctggcctcagtctgcagacgcctccngacctctcgtggctccaagctgagatgagctgattatactgcagctacgatatgcgaggcagcagcaatcgtacgtttcggacggacggtaccaacgtctacggaccgtccgtggtacaacggcccgaacggtcctacccggcccctcggtaccttacccg

SEQ ID NO: 305980 - DNA, 548 bp, Homo sapiens
  misc_feature: GZ8MTXP02GSTDM.2.35.D02.1.454.CMB.2.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacacaccccggcaacgcccccaaactcctcatttatgagtcactaagcgtcccgttaggggtccctgactcgcttctctgcctcagtctgcagacgcctccngacctcncgtggctcagctgngatgagntgattatactgcagtctcattagcgacgaggcagacagacctaagttcgttacgtttcgggacgggacgggaaccaacggctacggtacccggttccgtacgggtaccgaaccgacccggacggtcctcccggcccccgttcggtaccctacccg

SEQ ID NO: 305981 - DNA, 539 bp, Homo sapiens
  misc_feature: GZ8MTXP02HC3PW.2.35.D02.1.454.CMB.2.raw
tcagacgctcgacacacgaccggtgctcgatttagcacacgatagttgggtttgggtgtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctgtatcaacacaccccggcaacgcccccaaactcctcatttatgaggtcaacgtaagccggtcccgttaggggtccctgactcgtcttctctcgctccagtctggcagaccggcctccctgaccgtctcgtcgggcctccgaagctgacggatgagtctagtattatactgacagtctactatatgacagcagcagcaagtgttacgtttcggacggtacggacctaagcgtacgaccgtcgtaggtaaccgacgacccgagtccgtccgtccccgtcggtccc

SEQ ID NO: 305982 - DNA, 619 bp, Homo sapiens
  misc_feature: GZ8MTXP02I4QCT.2.35.D02.1.454.CMB.2.raw
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
  modified_base (403)..(403): a, c, t, g, unknown or other
  misc_feature (403)..(403): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcactggagcagcagtgacgttggcgttataactntgtctctgtatcaacacacccgcgaacgccccaaactcctacatttangagtcactaagcgtccgttaggggtccctgactcgcttctctggcctccagtcgtggcacgaacgcctcctgaccgtctcgtcgggtcctaccaacgctaggagntggacgtcgtagtatttagtactgactagtcttacagttagtcgaccgagcgaacggcaacgtactaaagttcggtttaaccgtttaccggggacggggtaacgggacccgtaaacggtccgttaccgggacccgttaccgggtaccgggtacgaaccggacccggtaaacgggtccccgtacccggtaccccccgttacgggttcctaaccccgg

SEQ ID NO: 305983 - DNA, 580 bp, Homo sapiens
  misc_feature: GZ8MTXP02FPZLC.2.35.D02.1.454.CMB.2.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccntctcctgcactggagcagcagtgacgttggcgttanaactntgtctctggtatcaacaacaccccggcgaacgcccccaaactcctcatttacngagtcactaagcgccttagggccctgactcgtcttctctggcctccgaagtctggctagaacgcctacctgaccgtctcgtggctccaagtctagagatgagtcngtattatactgcagctacagttacncgacgacgacagacgagtacgtaagttacgtttacggttacgggacgggtaacggtaaccgtaacggtcgtaaccggtaccgtacgtacggttacggaaccgtaccggaacccgtacggtcccgtacccggtcccccgtacgtacccg

SEQ ID NO: 305984 - DNA, 560 bp, Homo sapiens
  misc_feature: GZ8MTXP02J1KB3.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaaccaccccggcgaacgcccccaaactcctctatttangaggtcactaagcggtcccgttacggggtccctgactcgcttctcgtggccctccagtctgcagaccgcctcctcgacccgtctcgtcgggtcctacccgaagccgtggaaggtagtggaggctagtaatttacttacgtgcagctacgatagtcgacgaggcagacagactaagttcgttacgtttcggacggacggaccacgcgtacgaccgtcgtacgggtcaacgcccgacgcctaccgccctcggtctaccg

SEQ ID NO: 305985 - DNA, 718 bp, Homo sapiens
  misc_feature: GZ8MTXP02IMHAF.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctccttggtatcaacaaccaccccggcaacgcccccaaactcctacatttangagtacacgtaagcggtcccttagggtccctgactcgctttctcgtcggccctaccagttctggcaacggaaccggcccttccctcgtacccgtccgttccgtcggggccttaccgaaagtcgtacggaggactgggaaggtcttagtaatttacgttaacgtcgtcgtacggtaccttccgtaagtttacgtcggtacgaacgggacgaacggaccgaagtaccgttaaaagtttcggtttaaaacccggtttttccgggggaccggggtaaaacgggggtaaaccctaaaacgggtccgttacgggtaaacccccggtttaccggtcgggggttacccgtaaaccgggtacccccgaaacggggtccccctaacccgggtccccccccgtttcggggtaccctttaaccccgg

SEQ ID NO: 305986 - DNA, 552 bp, Homo sapiens
  misc_feature: GZ8MTXP02GDZ74.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
  modified_base (370)..(370): a, c, t, g, unknown or other
  misc_feature (370)..(370): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtatcaacacacccggcaacgccccaaactcctcatttangagtcactaagcggtccgttaggggtccctgactcgcttctctggcctccagtctgcagacgcctcctgaccgtcncgtcgggcctaccgaagctggagatggaggctgtatttatactgcagtctacattagtgcgacggcagacaggactaagttcgttacgtttcgggacggtacggaccgacgtcgtacggtacccgttccggtcggtacaacggacccgaacggtcctccggtcccccgtacggtcctacccg

SEQ ID NO: 305987 - DNA, 566 bp, Homo sapiens
  misc_feature: GZ8MTXP02GPSYZ.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctcctggtatcaaacaacaccccggacgaacgacccccaaactcctacaatttangaggtccaactaacggccggtccccgttaggggtcccctgacttcgcttctctggccctccaagtctggcaggaacgcctccngaccgtctcgtcgggcctaccaagctgacgatggagtctagtattacgttacngcaagtctacattagtgacgaggaccagcagacaagttcgttacgtttcggacgggtacggacctaagcgtacgaccgtcgtggtaccaacgaccgaaggccctcgcccccgtcggtctacccg

SEQ ID NO: 305988 - DNA, 551 bp, Homo sapiens
  misc_feature: GZ8MTXP02F0YZP.2.35.D02.1.454.CMB.2.raw
  modified_base (249)..(249): a, c, t, g, unknown or other
  misc_feature (249)..(249): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggacggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccggcaacgcccccaaactcctcatttatgagtcactaagcggtcccgttaggggtccctgactcgtcttctcgtggcctccagtctggcagaaccggcctccctgaccgtctcgtcgggctccaagctgacggatggagtctgtattacttcngcagctcatntgacagcagcagctaatgtacgtttcggacgggacggaccaagcctacggtacccgtaccgtggggtaccaacggaccccgaaggtcctcccggtcccccgttcgggtcctacccg

SEQ ID NO: 305989 - DNA, 517 bp, Homo sapiens
  misc_feature: GZ8MTXP02HINI4.2.35.D02.1.454.CMB.2.raw
  modified_base (249)..(249): a, c, t, g, unknown or other
  misc_feature (249)..(249): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctcctggtatcaacaacaccccggacgaacgcccccaaactcctcatttatgagtcactaagcggcccgttaggggtccctgatcgcttctctgcctcagtctgcagacgcctcctgacctntcnggctcagctgagatgagctgattatacngcagctcatatgacgagcagcagcaagtcgttacgtttcggacggtacggaccaagctacggaccgtcgtacggtcaacgacccgaggcctccgcccccgtcggtcctaccg

SEQ ID NO: 305990 - DNA, 594 bp, Homo sapiens
  misc_feature: GZ8MTXP02HNAKR.2.35.D02.1.454.CMB.2.raw
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctggtatcaacaacnccccggcaacgccccaaactcctactatttangaggtcactaagccggccgttaggggtccctgactcgcttctctggcctccagtctggcagacgcctcctgacctctcgtggctccagctgagactgacgctgtattagttactgctagtctcatatgcgaggcaggcacggactaacgttggttaaccgttttcgggacggggaacgggtaaccgtaaacgtccggtacggtaacccgttccggttacggggtacctaaccggaccccggtaaacgggtcccgttaccccggaccccccggtttcgggtaacccctttccccgg

SEQ ID NO: 305991 - DNA, 509 bp, Homo sapiens
  misc_feature: GZ8MTXP02GGDDR.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (390)..(390): a, c, t, g, unknown or other
  misc_feature (390)..(390): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctggtatcaacacacccggcgaacgccccaaactcctcatttangagtcactaagcggccttaggggccctgactcgcttctctggcctccaagtctggcagacggcctcctgaccgtctctgggctccaagctgagntgagctgattatactgcagctacatagtgcgagcagcagacatgtacgtttcggacggtaggacaacgcgtcgaccgtcgtcggtcaacgccgaacgccgccgtcccgtcggcctaccg

SEQ ID NO: 305992 - DNA, 563 bp, Homo sapiens
  misc_feature: GZ8MTXP02HWOAP.2.35.D02.1.454.CMB.2.raw
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttanactntgtctctggtatcaacacaccccggcaacgcccccaaaactccctactaatttactggtacggtacaacgtaaacgcggtaccccgttaaggggtcccctggtactcgctttcnctggcctcagtctgcacgacgcctacctgaccgtctcgtcgggctaccgaagctagacgatggagtctgtattacttactgacagtctacattangacgaggcagcganctaattcgtacgtttcggacggaaggtaccaaggtctacggaccgtccgtggtaccaacgccgaacgtcctaccggtccccctcggtacctccg

SEQ ID NO: 305993 - DNA, 578 bp, Homo sapiens
  misc_feature: GZ8MTXP02GGROM.2.35.D02.1.454.CMB.2.raw
  modified_base (300)..(300): a, c, t, g, unknown or other
  misc_feature (300)..(300): n is a, c, g, or t
  modified_base (556)..(556): a, c, t, g, unknown or other
  misc_feature (556)..(556): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttatactatgtctctgtatacaacaaccaccccggcaacgacccccaaactcctacatttangagtacaacgtaacgccggtccgttagggtccctgactcgtcttctctcggccctacagtctggcacggaacgccctccgtcgaccgttctcgtcgggtcctaccaagcgtaggaggagtggagtcgtagtattaactacgtagcgtagacctatagtactagaccgagaccagcacgataagttcgttacgtttcgggacggtaacgggaacgacgtaccgtcgtaccgtacgtcggtacaacgtaccgacgtcnccggtccccgtcgtacctaccg

SEQ ID NO: 305994 - DNA, 519 bp, Homo sapiens
  misc_feature: GZ8MTXP02IH3S9.2.35.D02.1.454.CMB.2.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaaacaacaccccggcaacgcccccaaatccctcatttangagtcactaagcgccttaggggtccctgatcgcttctctggcctccaagtctggcagacgcctccngacctctcnggctcaagctgagntgagctgtattattactgcagctcatatgcaggcagcagacaatgtacttttcgggacggagggaccaaagtcgacgtaccgtccgtggtacaacggacccgaaggcctacggcccccttcgtcgtccc

SEQ ID NO: 305995 - DNA, 528 bp, Homo sapiens
  misc_feature: GZ8MTXP02JBS01.2.35.D02.1.454.CMB.2.raw
  modified_base (297)..(297): a, c, t, g, unknown or other
  misc_feature (297)..(297): n is a, c, g, or t
  modified_base (412)..(412): a, c, t, g, unknown or other
  misc_feature (412)..(412): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttgcgttatactatgtctctgtatcaacaacaccccggcgaacgcccccaaactcctcatttangagtcactaagcggcccttagggtccctgatcgcttctctggcctccagtctggcacgacgcctcctgaccgtctcgtgggctccaagctagacgatgaggctgtatttattacngcagctcatatgcaggcagcagctaatgtactttcggacggaggtaccaagtcgtacggacccgttccgtcgggtacaacggcccgaacggtcctccgcccccgtcggtacctccg

SEQ ID NO: 305996 - DNA, 542 bp, Homo sapiens
  misc_feature: GZ8MTXP02JC6M0.2.35.D02.1.454.CMB.2.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaacaccccggcgaacgccccaaactcctactatttangagtacactaagccggtccgttacggggtccctgactcgcttctcgtgcctccagtctggcagacgcctccgtgaccgtctcgtggcctcaagctgagntgagtctgtattacgtactgcagtcctnactagtcgacaggcagacagactatcgttacgtttcgggacggacgggaccacggtctacggccgtacgtggtaccaacgtccgaacggcctccgccccgttggtacctaccg

SEQ ID NO: 305997 - DNA, 567 bp, Homo sapiens
  misc_feature: GZ8MTXP02JG2A4.2.35.D02.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctcctggtatcaacaacaccccggcgaacgcccccaaactcctcatttangagtcactaagcggccttaggggtccctgatcgcttctctgcctcagtctgcagacgcctcctgacctcnctggctccagctgagatgagctgattagtactgcagctacatagtgacgaggcaggcaaggcaaattcgttaacgttttcggggacggtacggggtaaacccaaacggtccgtacggtaacccgttccggtacggggttaccaaccggaccccgaaacgggtccctaccggacccccgttacggggtcctaacccg

SEQ ID NO: 305998 - DNA, 649 bp, Homo sapiens
  misc_feature: GZ8MTXP02J2DNY.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttaataactntgtctcctggtactcaacaaccaccccggcgaaaccgcccccaaaactcctactaatttactggacggttaccaacgtaaacggtccggtaccccgtttacggggtcccctaggacttccgtcttctcgtcggcccctaccgaagtcgtcggcaacggtaaccggccctcccgtcgtacccgtcgtcgtcgggcctacgacgtcgtacgaggatggagtctagatttaattacgtcgcagtctacgatagtgaccgaggcgacgcaaggctaaagttcgtttaacggtttcgggacgggtaaacgggaccgaaacggtcctacggtacccggtacggttccgggtaccaacggacccgaacggtcccgtaccggtccccccgtacgggtcccttacccg

SEQ ID NO: 305999 - DNA, 606 bp, Homo sapiens
  misc_feature: GZ8MTXP02JLT99.2.35.D02.1.454.CMB.2.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcactggagcagcagtgacgttggacgttanaactntgtctcctgtactcaacaaccaccccggacgaaccgacccccaaactcctactatttancgtagtacaactaaggccggtcccgttaggggtccctgactcgtcttcncgtgccctcagtcngcagactcgcctcgtcgtccgtctcgtcggctaccgagtctgagatgagtctagtattagtcgtcgacacgtctacagtatcggacacggacacgtacaggtaccttaaagttcgtttaacccggtttcggggaacgggtacggggaacctaaacgggtcgttaccggacccggttcgtacggggtaaccaccggacccgtacggggtcctacccggtccccgttcggtaccc

SEQ ID NO: 306000 - DNA, 559 bp, Homo sapiens
  misc_feature: GZ8MTXP02I4R7A.2.35.D02.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcgaacgcccccaaactcctcattttangaggtcactaacgcgcccgttaggggccctgactcgcttctctcggcctccaagtctggcacgaaccggcctacccgtgacccgtctcgtagggcctaccaagcctggagatgaggctgtatttatatgcagtcctanactatgacgaggcagnaagacaagttacgttacgtttcggggcgggaacgggacctaacggctacgtaccgtcgtggtaccgaacgcccgaacgcgtcccgaccccgtcggtcctaccg

SEQ ID NO: 306001 - DNA, 556 bp, Homo sapiens
  misc_feature: GZ8MTXP02IZDP6.2.35.D02.1.454.CMB.2.raw
  modified_base (247)..(247): a, c, t, g, unknown or other
  misc_feature (247)..(247): n is a, c, g, or t
  modified_base (412)..(412): a, c, t, g, unknown or other
  misc_feature (412)..(412): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaccacccggacaacgccccaaactcctactatttatgagtcaacgtaacgccggtacccgttacggggtcccctggactccgtcttctcgtcggccctccaagtctggcacgacgcctccgtcgaccgtctcgtcggctaccagctgagntgagctgtattatactgcagtctanattagngcgagcagcagctaagttcgtacgtttcggacggtacggaccgacgtaccgtcgtacccgtcgtacggtaccgaacgaccggaacgtccgtcccgccccgtcggtacctcccg

SEQ ID NO: 306002 - DNA, 518 bp, Homo sapiens
  misc_feature: GZ8MTXP02G71FY.2.35.D02.1.454.CMB.2.raw
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctgtatcaacaacaccccggcaacgcccccaaatcctactatttangagtcactaagccggtacccttaggggtccctgatcgtcttcnctgccctcagtctgcagacgcctccgtgaccgtntcgnggctcaagctgagntgagctgtattatactgcagctnatatgcagcagcagctagttcgttacgtttcgggacgacgaacgacgtcgtacgaccgtcgcggtacaacgaccgacgccgtccgccccgtcgtacctaccg

SEQ ID NO: 306003 - DNA, 526 bp, Homo sapiens
  misc_feature: GZ8MTXP02FUS9X.2.35.D02.1.454.CMB.2.raw
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (433)..(433): a, c, t, g, unknown or other
  misc_feature (433)..(433): n is a, c, g, or t
  modified_base (486)..(486): a, c, t, g, unknown or other
  misc_feature (486)..(486): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggcgaaacgcccccccaaaactccctacattttangaggtcactaagcggcccttaggggtcccctgatcgcttcnctggcctccaagtctggcagaacgcctccctgaccgtctctgggctaccaagctgagatgagctgattatactgcagctanattatgcaggcagcagcatgtactttcggcggaggacaagctacgaccgtcgngggtcaagcccgaaggcctacgcccccgtggtacctaccg

SEQ ID NO: 306004 - DNA, 516 bp, Homo sapiens
  misc_feature: GZ8MTXP02FNO2K.2.35.D02.1.454.CMB.2.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaacaccccggcaacgcccccaaactcctacatttangagtcactaagcggccttaggggccctgactcgcttctctggcctccaagtctggcagaacgcctccngaccgtctcgtggctccaagctgagatgagctgattatctgcagctanatangacagcagcagacaatgttacgtttcggacggtacggaccaagtctacgaccgtcgtgggcaacgcccaaggcctcgcccctcggtctaccg

SEQ ID NO: 306005 - DNA, 557 bp, Homo sapiens
  misc_feature: GZ8MTXP02HOBGI.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctggtatacaacacaccccggcaacgccccaaactcctcatttatgagtcaactaagcggtccgttacggggtccctgactcgcttctcgtggccctacagtctcggcacgaacgcctccgngaccgtcctcgtcggctacgagtcngagntgagtctgtatttactacgtgcagtcctctattatcgacgacggcaggcaggtactaagttcgttacgtttcgggacggacgggtaccaacggtcgtacgaccgttaccggcggtcgaacgccgaacggcctccgtccccgtacgtctacccg

SEQ ID NO: 306006 - DNA, 597 bp, Homo sapiens
  misc_feature: GZ8MTXP02GLU86.2.35.D02.1.454.CMB.2.raw
  modified_base (249)..(249): a, c, t, g, unknown or other
  misc_feature (249)..(249): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctctgtatcaacaaccaccccggcgaacgcccccaaactcctactatttatgacggtcaacgtaagccggtcccgttaggggtcccctgacttcgcttctctcggccctacaagtctggacacgaacggccctccctgacccgtctccgtgggcctaccgaagctggaggactggagtctgtactttatactgacagtctacgatagtcgacaggccaggcaacggactaaagttcggttacgtttaccggggacgggtaacggtaaccaacggtcctacggtacccgtccgtacgggtacaaccggaccaacggtcctacccggtccccgtcggtaccctaccg

SEQ ID NO: 306007 - DNA, 568 bp, Homo sapiens
  misc_feature: GZ8MTXP02F5N7K.2.35.D02.1.454.CMB.2.raw
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaacaccccggcaacgcccccaaactcctnatttangagtcactaagcggtcccttaggggtccctgactcgcttctctggccctcaagtctggcagacggccctcctgacctctcgtgggcctcaagctagaggatgaggctagtatttattacgngacagtctatatntgacgagacagcagactaagttcgttacgttcgggacggacggtaacctaacgtccgtacggtacccgttccgtacgggtaccgaaccggacccgtaacggtcccgtcccgtcccccgttacgtccctacccg

SEQ ID NO: 306008 - DNA, 613 bp, Homo sapiens
  misc_feature: GZ8MTXP02HK5JM.2.35.D02.1.454.CMB.2.raw
  modified_base (247)..(247): a, c, t, g, unknown or other
  misc_feature (247)..(247): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttataactntgtctctgtatcaacaacaccccggcgaacgcccccaaactcctactatttatgagtcaacgtaagcggtacccgttaggggtcccctgactcgcttctctcggccctccaagtctggcacgaaccgcctcccgtcgacccgttcgtccgtcgggccttccgaagtcgtacggaggagtggaaggtctgtaatttagtactgacgagtctactattagtacgcgaggaccgagaccaaggacctaaagtttacggtttaaccgtttacggggaccgggtaacgggtaaaccgaacggtagtaccggtaaccgtccggtacggtacgaaccgccgaacggtccacccggtcccctcggttactcccg

SEQ ID NO: 306009 - DNA, 560 bp, Homo sapiens
  misc_feature: GZ8MTXP02GVTXT.2.35.D02.1.454.CMB.2.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcactggaggcagcagtgacgttggcgttanaactntgtctctggtatcaacaacaccccgnaacgcccccaaatcctcatttangagtcactaagcggccttaggggccctgactcgcttctctgcctcagtcngcagaacgcctccngaccgtctcgtggctcaagtctgacgatggagtctagtattatactgacagcttacattatgcgaggccaagcacgactaagttcggtttacgtttcggacgggtaacgggaccaaacggtcctaacggtcccgtacgttcgggaccgaacgtacccgaacggtccctacccggccccgttcggtaccctacccgg

SEQ ID NO: 306010 - DNA, 552 bp, Homo sapiens
  misc_feature: GZ8MTXP02G8BU4.2.35.D02.1.454.CMB.2.raw
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactntgtctctgtatcaacacaccccggcaacgcccccaaactcctactatttangagtcactaagccggtcccttaggggtccctgactcgcttctcgtgccctcagtctggcagaacgcctcctgaccgtctcgtgggcctaccaagctagagatggagtctgattatactgcagctacatatgacgaggcagcagactaagttgttacgtttcgggacggacggtaccaacgtcgtacggtacccgtccgtaggtaccgaaccggtacccgaacggtccctcccgtcccccgtcggtacctacccg

SEQ ID NO: 306011 - DNA, 575 bp, Homo sapiens
  misc_feature: GZ8MTXP02HF62T.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (444)..(444): a, c, t, g, unknown or other
  misc_feature (444)..(444): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtancaacacacccggacgaacgccccaaatcctcatttatgagtcacaagcggcccgttagggccctgactcgtcttctcgtaggcccctacgagtctcggacacgaccgccctccgcgtaccgtctcgtcggctaccgagtcgtgacgtagtggagtcgtagtatttatactgctagcctataagttncgacgacgacgacgactacgtactagttacgttacggttcggacggtacgacgacgtcgtaccggtaccgtcggtacggtaccgaaccggaccgtaccggtcccgtacccggtccccgttcgtacctaccg

SEQ ID NO: 306012 - DNA, 523 bp, Homo sapiens
  misc_feature: GZ8MTXP02HFSKY.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctgtatcaacacacccgnaacgccccaaactcctcatttangagtcactaagcgtcccgttagggtccctgactcgcttctctgcctcagtctagcacgacgcctcctgaccgtctcgtcggctccaagctgagatgagtctagtattattacngacagcctnaattngcgaagcagcagctaagtcgtacgtttcggacggacggacagcgtacgaccgtcgtcgggtacaaccgaccgaacgtcctccgtcccccgtcggtactcccg

SEQ ID NO: 306013 - DNA, 571 bp, Homo sapiens
  misc_feature: GZ8MTXP02G9TD9.2.35.D02.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttanaactntgtctcctggtatcaaacaacaccccggacaacgcccccaaactcctacatttatgaggtcaactaagccggtcccttaggggtcccctgactcgcttctctggcctccaagtctggcagaaccggcctccctgacccgtctcgtgggcctccgaaagctggagatggagctagattattacngacagcctnatatgacagcagcaagcaagttcgttacgtttcgggacgggacggaacccaaagtccgtacggtacccgtcgtggggtaccaacggaccccgaaaggccctaccggccccccgtcggtttacctaacccg

SEQ ID NO: 306014 - DNA, 558 bp, Homo sapiens
  misc_feature: GZ8MTXP02G8TCG.2.35.D02.1.454.CMB.2.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctctggtatcaacaaccgaccccggcgaacgcccccaaactcctacatttangacggtcactaacgcggcccttaggggtcccctgatcgcttctctgcctcatcngcagacgcctccngaccgtntcgtggctccagctgagntgagctgattatacgtgcagcttanatatgcaggcagcagactaatcgttacgtttcgggacggggaacggtaccaaaggtccgtaacggtcccggttcccgtggggtaccaacggacccgtaaacgggcccgtccggccccccgttacggtcccttacccg

SEQ ID NO: 306015 - DNA, 600 bp, Homo sapiens
  misc_feature: GZ8MTXP02IJBRK.2.35.D02.1.454.CMB.2.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatcncctgcactggagcagcagtgacgttggcgttataactatgtctctgtatcaaacacacccgcaacgcccccaaatcctacatttangagtcaactaagcggtaccgttagggtccctgactcgtcttctctggccctaccagtctggcacggaaccgcctcctgacccgttctccgtgggcctaccgaagtctaggaggagtggaaggctagtatttacgttactgctagctacattacgtgacacggcaaggcaagtacaaagttcggttacgtttacggggacggtaacgggtaaccaaacggtaccgtacggtacccggttccggttacgggacctaaccggccccgtaaaggtcccgtaccggtcccccgttacggtacctaacccg

SEQ ID NO: 306016 - DNA, 503 bp, Homo sapiens
  misc_feature: GZ8MTXP02FOZ2F.2.35.D02.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgcccctgactcagcctccctccgcgtccgggtctcctggacagtcagtcaccatctcctgcactggagcagcagtgacgttggcggttanaactntgtctctggtatcaacaacaccccggnaacgcccccaaactcctcatttangaggtcactaagcggcccttaggggtccctgatcgnttctctggcctccagtctgcagacgcctccngaccgtctntggctcaagctgagatgagctgtattattactgcagctcatatgcagcagcagcaatgtactttcggcgtagggaccaagctacgaccgtctgggtcaagcccaaggctcgcccctcggtctaccg

SEQ ID NO: 306017 - DNA, 684 bp, Homo sapiens
  misc_feature: GZ8MTXP02GCXJS.2.35.D02.1.454.CMB.2.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggcaacgacccccaaactcctacatttangacgtcactaagcggtcccgttaggggccctgatcgtcttctctcggccctaccgaagtcgtggacacgaccgcctccctcgtacccgtctcgtcgggacctaccgaagtccgtagacggagtacggaggtctagtaatttacgttaacgttcgactaaacggtccttacgtaagttaacgttcggaccggaacgggacacggaccgaacggtacctaaagttttacgggtttaaccgttttccgggggaacgggtaaacggggaacccgtaacgggtaccggttaccggtaaccccggtttccggtaccgggttaacccgaaacggtcccccgaaaagggtccccgtaccggtacccccccggttcgggtaaccctttaccccgg

SEQ ID NO: 306018 - DNA, 566 bp, Homo sapiens
  misc_feature: GZ8MTXP02JWETQ.2.35.D02.1.454.CMB.2.raw
  modified_base (243)..(243): a, c, t, g, unknown or other
  misc_feature (243)..(243): n is a, c, g, or t
  modified_base (298)..(298): a, c, t, g, unknown or other
  misc_feature (298)..(298): n is a, c, g, or t
  modified_base (438)..(438): a, c, t, g, unknown or other
  misc_feature (438)..(438): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctgtatcaacaacacccggcgaacgcccccaaactcctacatttangtagtcaactaaggccgtcccgttaggggtccctgactcgtcttctcgtgcctccagtctgcagacggcctcctgaccgtctcgtcgggcctacccagtctggagactggaggtctagtatttactactgactagcctanatatgaccaggcagcacgactaagttgtttaacgtttcgggaccggtaagggaccaagtccgtacggtacccgtccgtaggtaccgaacggcccgaacggtcctaccggccccctcggaccttacccg

SEQ ID NO: 306019 - DNA, 608 bp, Homo sapiens
  misc_feature: GZ8MTXP02HAQ6Q.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggagcagcagtgacgttgcgttanaactntgtctctggtatcaacaaccacccggcaacgcccccaaactcctactatttangagtcactaagccggtccgttaggggtccctgactcgcttctcgtggccctcaagtctgcacgacgcctccgtgaccgtctcgtcgggcctccgaacgtcgtacggagatggagggtcttagtactttaacgtttacgcggacaacggtccttacaagtttagcggaccgtaagggccacgacacggacctaaagtttcggttaaccgtttcggggaacggtacgggtaccaaacggtcgtacggaacccgttcgtaggtaccgaacgcccgaaggtcccgtaccggcccccttgggtaccctaccg

SEQ ID NO: 306020 - DNA, 720 bp, Homo sapiens
  misc_feature: GZ8MTXP02IWWX8.2.35.D02.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
tcagacgctcgacacacgaccggtgctcgatttagcacacgatagttgggtttggggttctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttaanaactntgtctctgtatcaaacacacccggcaacgcccccaaactcctacatttacngacggtcaactaaggccggtcccgttaggggtcccctgactccgtctttctcgtcgccctaccaagtctacggcaacggtaaccggcccttcccgtacggacccgttcttccgtacggggtccttaccgaaacgtcctaggaacggtagttacgggacggtactttacggtaatttaacgttaaccgttggacctaaacggtccttacgtaatttaccgttaggccggaaagggccaaagggcctaaaggacctaaacggtttacggtttaccggttttaccggggaaccggggttaaacggggaacccttaaaaggccggttaccggtaccccggttaccggttacggggtacccgaaccggaccccgttaaacgggcccgttccccggtaccccccgttcgggttaccccttaaccg

SEQ ID NO: 306021 - DNA, 594 bp, Homo sapiens
  misc_feature: GZ8MTXP02GK9KF.2.35.D02.1.454.CMB.2.raw
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaacaaccaccccggcaacgcccccaaactcctacatttatgagtcactaagcggtccttaggggtccctgactcgcttcnctggcctcagtctgcacgacgcctccngaccgtctcgtggctccgaagctaggacgatggacggtctaggtatttacttacgtgacacgtcttacattagcgacgaggaccaaggccaaggtactaaagtttcgtttaacgttttccggggacgggtaacggggaccctaaaggtccgttcggacccgttccggtcgggtaccaacggacccgtaacggcccttaccggccccccgttcggtacctacccg

SEQ ID NO: 306022 - DNA, 667 bp, Homo sapiens
  misc_feature: GZ8MTXP02J2R5Z.2.35.D02.1.454.CMB.2.raw
  modified_base (269)..(269): a, c, t, g, unknown or other
  misc_feature (269)..(269): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctcctggtatcaacaaccnccccggcgaaacgcccccaaactcctacatttatgacggtcaactaacggccggcccgttacggggtccctgactccgtctttctcgtcggccctaccaagtcctaggcaacggtaccgggtccctccgtcgacccgttctccgtcggggacctacccgaagtcctagggaggacttgggaacggcttagtaatttacttaacgtgcgaacgtcctacgtattacgaggccgaaggacgacgaccgaagtaccgtaaagttcgggtttaaaccgtttcgggggaacgggtaacgggaccgtaacggtccgttacgggacccggttccggttacggggtacctaaccggtaccccgtaacggcccgttacccggtcccccgttacggtccttaccccgg

SEQ ID NO: 306023 - DNA, 510 bp, Homo sapiens
  misc_feature: GZ8MTXP02I7P4J.2.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (479)..(479): a, c, t, g, unknown or other
  misc_feature (479)..(479): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggcaacgccccaaactccncatttangagtcactaagcgtcctagggtccctgactcgcttctctggcctccagtctggcacgaacgcctcctgaccgtctcgtggctccaagctgagatgagctagattattactgcagctacagtatgcagcagcaagcaagtgtacgtttcggacggtaggaccaagtctacgaccgtcgtcggtacncggtaccacggctcgccccctcggtctaccg

SEQ ID NO: 306024 - DNA, 823 bp, Homo sapiens
  misc_feature: GZ8MTXP02HEN9Q.2.35.D02.1.454.CMB.2.raw
  modified_base (243)..(243): a, c, t, g, unknown or other
  misc_feature (243)..(243): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcacgtggagcagcagtgacgttggcgttanactatgtctctggtatcaacaaccgaccccggacgaaccgaccccccaaaactccctactaattttatcggtaacggtcaacgtaaacggccggtaccccgtttaacggggtcccctaggacttccgtctttcctcgtcgggtcccctacccgaaagttccgtacgggaccaacgggaaacccgggtcccttacccccgttacggtaacccccggtttccgtccgttcgggggacccttaccccgaaagtccgttacggaaagggtaacgttggaacgggtccgtttaggtaaactttttaacgtttaacgttcggacctaacgggtacctttaccgtaatttaacgttcgggtaccgtaacgggtaccgaacggacccgttaaacggaaaccgttaaacgttttaccggttttaaaaccgggtttttccgggggaaaccgggggtttaaacgggggtaaacccgaaacgggttaccggttaccggggtaaccccggttcccggtacgggggttaccaacccgggacccgtaaaccgggtcccgtaacccggtaccccccggttcggtacccttaccccg

SEQ ID NO: 306025 - DNA, 669 bp, Homo sapiens
  misc_feature: GZ8MTXP02H639C.2.35.D02.1.454.CMB.2.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggagcagcagtgacgttggcgttanaactatgtctctgtancaacacacccggnaacgccccaaactctactatagngtcacaacgacggccgtacggtcgtctagctctcttctcggtctccccaagtcgtcgcgacgaaaccggtcccgtccctccgtacgtccgttccgtcgggtaccgtccctaagacccgttggagggaaacgtggtacgggacgttgttaaacgttacgttttaccgacgtcgaaacgtcgtaccttagtaagttcgacgacggacggacaacgacgtaagtaaactttcgggtttaaccgttttcgggggacggaaaacgggggtaaaccgtaaacggcgttaaccggccgggtttaacccgtcggggttaccgaaccgaacccggtaacgggtacccgtcccggtccccgacccggtttacggtacccttcccg

SEQ ID NO: 306026 - DNA, 552 bp, Homo sapiens
  misc_feature: GZ8MTXP02INTIL.2.35.D02.1.454.CMB.2.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttataactntgtctctgtatcaacacacccggcaacgacccccaaatcctactatttangagtcaactaaggcggtccgttacggggtccctgatcgtcttctcgtcggccctccagtctggcacggaccgcctcctcgaccgtctcgtcggctacgagcngagatgagtctagtattatctgcagtctacatatgacgacggcagcagactagttcgttacgtttcggacggtaacgaaacacgtcgtacggtacccgtcggtggtaccaacgacccgaacggtcccgtaccgcccccgttcggaccctaccg

SEQ ID NO: 306027 - DNA, 528 bp, Homo sapiens
  misc_feature: GZ8MTXP02IG0AG.2.35.D02.1.454.CMB.2.raw
  modified_base (242)..(242): a, c, t, g, unknown or other
  misc_feature (242)..(242): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggagcagcagtgacgttggcgttanaactatgtctcctggatcaaacaacaccccggacgaacgcccccaaaactcctacatttatgaggtcaactaagcggtcccttaggggtaccctgatcgcttctctggcctccaagtctggcagaacggcctcctgtacctctcgtggctccaatctgagatgagctgattatactgacagcctanatangacgagcagcagactaagttagttacgttcggacggacggacacgcgtacgaccgtcgtacggcaacgaccgacgcctaccgccccgtcgtccncg

SEQ ID NO: 306028 - DNA, 559 bp, Homo sapiens
  misc_feature: GZ8MTXP02HUNPQ.2.35.D02.1.454.CMB.2.raw
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (373)..(373): a, c, t, g, unknown or other
  misc_feature (373)..(373): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttataactntgtctcctgtatcaacacnccccggcgacgcccccaaactcctcatttangtagtcactaagcggtcccgttacggggtccctgactcgtctttctctggcctccagtcagcacgaacgcctccgngaccgttctcgtcggcctccaagcgtagagatggagtctgtatttatacgtgacagctacattntcgagagacngacagactaattcgttacgtttcgggacggtacggaccgaacgtcgtacgtacccgtcgtcgggtcaaccggacccgacggtcccgtcgtacccccgtggttccccttaccg

SEQ ID NO: 306029 - DNA, 557 bp, Homo sapiens
  misc_feature: GZ8MTXP02IB141.2.35.D02.1.454.CMB.2.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctcgcgtccggtctcctggacagtcagtcaccatctcctgcactggagcagcagtgacgttggcgttataactntgtctctgtatcaacacacccggngaacgcccccaaactcctcatttangagtcaactaagccggtccgttaggggtccctgtactcgtctttctctggcctaccaagtctaggcaacggacgcctccgtgaccgtctcgtcgggctacccgaagtctgaggatggagtctagtattactacgtgcagtctacatatcggacaggcagtacgagactaagtgtttacgttaccgggaggtacgggacaacggccgtacggtaccgtcggttaggacaacggccgacgtccgccgccccgtaggtcctacccg

SEQ ID NO: 306030 - DNA, 575 bp, Homo sapiens
  misc_feature: GZ8MTXP02GR86Y.2.35.D02.1.454.CMB.2.raw
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
  modified_base (447)..(447): a, c, t, g, unknown or other
  misc_feature (447)..(447): n is a, c, g, or t
  modified_base (530)..(530): a, c, t, g, unknown or other
  misc_feature (530)..(530): n is a, c, g, or t
  modified_base (555)..(555): a, c, t, g, unknown or other
  misc_feature (555)..(555): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctctgcactggagcagcagtgacgttggcgttataactntgtctctgtatcaaacaaccgaccccggacaacgacccccaaactcctcatttangagtcactaagccggtccgttagggtccctgactcgtcttctcgtggccctccgaagtctcggacaacggaaccggtccctcccgtagacccgttctccgtcgggcctaccgaagctaggagtatggaggtctgtaatttattacgngtcagtcctatattagtgacgaggcagcagactaagttacgttacgttcgggacggtaacggaccaagctacggaccgttcgngggtacaacggacccgaacggtccncccgtccccgtcgtctaccg

SEQ ID NO: 306031 - DNA, 516 bp, Homo sapiens
  misc_feature: GZ8MTXP02IHFLA.2.35.D02.1.454.CMB.2.raw
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaacgaccccccaaactccctacatttangaggtcactaagcggcccttaggggtcccctgactcgcttctctggcctcagtctggcagacgctccngaccgtctctgggctcaagctgagntgagctgatttatactgcagctacatatgcaggcagcagcaattgtactttcggacggtaggacaaggctacgaccgtcctgggtcaacgcccgaaggctcgccccctggctaccg

SEQ ID NO: 306032 - DNA, 595 bp, Homo sapiens
  misc_feature: GZ8MTXP02JCMHX.2.35.D02.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacncccggnaacgccccaaatcctntattangagtcactaagcgccgttagggtccctgatcgtcttctctgccctcagtctgcagacgcctcctgaccgtctcgtggcctacgagcgtagacgagtggagtctaggtaatttacttacgtgtacagtccttacgattagtcgacggacgacgacgacgacgtacgtaacgtttacggttaccggttttacgggacggggtaacgggaaaccgaaacggtccgtacggtacccggttcgtacgggtaccgaacggacccgtaacgggtcctcccggtaccccgttcggtacccttacccgg

SEQ ID NO: 306033 - DNA, 629 bp, Homo sapiens
  misc_feature: GZ8MTXP02HT28R.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (365)..(365): a, c, t, g, unknown or other
  misc_feature (365)..(365): n is a, c, g, or t
  modified_base (462)..(462): a, c, t, g, unknown or other
  misc_feature (462)..(462): n is a, c, g, or t
  modified_base (605)..(605): a, c, t, g, unknown or other
  misc_feature (605)..(605): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggcgttanaactntgtctcctggtatacaaacaaccgaccccggacgaacgacccccaaaactccctacctatttataggacggttcaacgtaaagccggtacccgttacggggtccctgactcgctttcncgtcggtcctaccgaagtcgtaggcaacggaacggtcccttcccgtggtacccgtcgttcgtcgggaccttacccgaagcctaggaagagtaggagngtagtatttatacctagacctagctataattgtcgacgaagccgaagtccgaaggtacctaagttacgtttaaccggttttcgggaccgggaaacgggacaaacggctacggaccgttcgtcggaccgaacgacccgacgccnccgtcccccgtcggttaccctccg

SEQ ID NO: 306034 - DNA, 523 bp, Homo sapiens
  misc_feature: GZ8MTXP02FTTWY.2.35.D02.1.454.CMB.2.raw
  modified_base (305)..(305): a, c, t, g, unknown or other
  misc_feature (305)..(305): n is a, c, g, or t
  modified_base (488)..(488): a, c, t, g, unknown or other
  misc_feature (488)..(488): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaaacaacacccccggcgaacgcccccaaaactcctcatttangaggtcactaagcggcccttaggggtccctgatcgcttctctggccctcaagtctggcagaacggcctccctgaccgtctctgggctccaagctagagatgagctgattattactgcagctcatatgcaggcagcagcaagtcgttacgtttcgggcggtaggaccaaagctacgaccgtcgnggtcaacgcccaacggctcgcccctcggtctaccg

SEQ ID NO: 306035 - DNA, 519 bp, Homo sapiens
  misc_feature: GZ8MTXP02I1UZ1.2.35.D02.1.454.CMB.2.raw
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctggtatcaacaacaccccggcaagcccccaaatccacatttangaggtcactaagcggcccttaggggtccctgatcgcttcntggcctccagtctggcagaacgcctcctgaccgtcnctggctccaagctgagatgagctgatttatacngcagctanattncgacgaggcagacagactagttcgtacgtttcgggacggacggaacacggtctacgacccgtcgtaggtcaacgcccgaagccgtccgccccgtcgtccac

SEQ ID NO: 306036 - DNA, 631 bp, Homo sapiens
  misc_feature: GZ8MTXP02ITUEQ.2.35.D02.1.454.CMB.2.raw
  modified_base (248)..(248): a, c, t, g, unknown or other
  misc_feature (248)..(248): n is a, c, g, or t
  modified_base (391)..(391): a, c, t, g, unknown or other
  misc_feature (391)..(391): n is a, c, g, or t
  modified_base (456)..(456): a, c, t, g, unknown or other
  misc_feature (456)..(456): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaaccaccccggcaacgcccccaaaactcctacatttatgacgtcaactaacggccggtccgttacggggtccctgtatccgtctttctcgtcggccctaccgagtctggacacggacgcctcccgngtacccgtctcgtgggcctaccgaagtccgtgacggtagtgaagtcttaggtaatttacgttacncggctaaggtcttacgaatttacgcgacgaggccagaccgaagtaccgtaaagttcgttaaccgttttacggggacgggtaacggggtaccacggacgttcggaaacccgttcgtacggggtcaaccggcccgtaaacgggtccctccggtcccccgttagggtacccttcccgg

SEQ ID NO: 306037 - DNA, 672 bp, Homo sapiens
  misc_feature: GZ8MTXP02F9HKH.2.35.D02.1.454.CMB.2.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggagcagcagtgacgttggcgttataactntgtctctgtatcaacaacacccggacgaacgcccccaaactcctactatttangaggtccaacgttaacggccggtaccccgttacggggtcccctaggtacttccgtctttcctcgtcggcccctaccgtaagttcgtacgggacaacggaaccgggtcccttccccgtcggtacccgttccgttccgtcggggtccctacccgaaacggcgttacggaacggaagttcgggaacggtcgttaggtaattttaacgttaacgttcggacgtaacgtcttacattaagtcgacgaggccaggacacgactaagttcggttaacgtttcggggacggtaacgggaccaggtaccgtacgtaccgtccggtacgggtacaaccggacccgaacggtccctacccggtcccctcggtacctacccg

SEQ ID NO: 306038 - DNA, 694 bp, Homo sapiens
  misc_feature: GZ8MTXP02H308V.2.35.D02.1.454.CMB.2.raw
  modified_base (315)..(315): a, c, t, g, unknown or other
  misc_feature (315)..(315): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcagtggagcagcagtgtacggttggacggttataactatgtctccgtggtatacaaacaaccgaccccggacgaaccgacccccaaactcctactatttacnggtacggtacactaaaggccggtaccccgtttaaggggtcccctagactcgtacctttctcgtcggccctaccgaagtcgtacgggactaaggaacttccgggacccctttcccgtacggtaccccggttccttccggtacggggtacccttacccgaaagtccgtaggtacgggtaagttacggacgggtaccgtagttaacgtttaacgtttacgtcgtactaacggtcttacgttaataacgtcgaccgaggaccgtacgacagactaagttacgttacgtttcgggacggtacggaaccaacggtcgtaccggtaccgtccggtacggtaaccgacgaccgaacggtccgtaccccgtccccggttacggtcccg

SEQ ID NO: 306039 - DNA, 536 bp, Homo sapiens
  misc_feature: GZ8MTXP02HLVMO.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtatcaacacgaccccgcgaacgcccccaaactcctacatttangagtcactaagccggccgttaggggtccctgactcgcttctctggcctaccagtctggcacgacgcctcctgaccgtctcgtggctccaagctgagatgagctgtattatatgcagtctacattgtgcgagcagcagacagttgttacgtttcgggacggtagggtaccaacggtctacggtaccgtcgtagggtccaacgccgaagggtccctaccgcccccgtacggtcctacccg

SEQ ID NO: 306040 - DNA, 542 bp, Homo sapiens
  misc_feature: GZ8MTXP02JNQFY.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
  modified_base (368)..(368): a, c, t, g, unknown or other
  misc_feature (368)..(368): n is a, c, g, or t
  modified_base (426)..(426): a, c, t, g, unknown or other
  misc_feature (426)..(426): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctgtatcaacaacaccccggcgaacgcccccaaactcctcatttangaggtcactaagcggccttaggggtcccctgactcgcttctctggccctcagtctggcagacgcctccngaccgtctcgcggcctcaagctggagactgagctagatttatactgcagctacattangacgagccgagacgacgtacaagttcgttacgtttcgggacggtacgggaccaacgccgtacgacccgtcgtggtacaacgtacccgaacggctccgccccgttcggaccttaccg

SEQ ID NO: 306041 - DNA, 616 bp, Homo sapiens
  misc_feature: GZ8MTXP02GPVER.2.35.D02.1.454.CMB.2.raw
  modified_base (251)..(251): a, c, t, g, unknown or other
  misc_feature (251)..(251): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagccctccctccgcgtccggtctcctggacagtcagtccaccatcctcctgcactggagcagcagtgacgttggcgttataactntgtctctgtatcaacaaccaccccggacgaacgacccccaaactcctacatttatgacgtacacgtaacgccggtacccgttacggggtccctgactcgcttctctggccctccaagtctggcacggaaccgccctccctcgacccgtcgtcgtcgggcctcccgaaagcgtaggagagtggaggtctagtatttaattacgtagcaacggtcctacattagtcgacgaacggccagcaacgactaaagttcgttaacgttttcgggacggtaacggaacctaaacgtccgtacgtacccggtccgtcgggtaccgaacggtaccccgaacggtcccgtcccggtaccccctcgggtcctacccg

SEQ ID NO: 306042 - DNA, 524 bp, Homo sapiens
  misc_feature: GZ8MTXP02IQF58.2.35.D02.1.454.CMB.2.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctctgcactggagcagcagtgacgttggcgttataactntgtctctgtatcaacacacccggcaacgcccccaaatcctacatttangaggtcactaagcgtccttagggtccctgatcgcttctctcggcctaccagtctgcagacgcctcctgacccgtctcgtgggctcgagctgagatggagctgtaattattactgcagtctacattatgacacggcaggacaggacagttcgttacgtttcgggacggagggaccacggtctacggtaccgtcgtggtcaacgccgaacggtcctcgccccgttcgacgtcc

SEQ ID NO: 306043 - DNA, 560 bp, Homo sapiens
  misc_feature: GZ8MTXP02FKD3Z.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctggtatcaacaacaccccggcaacgcccccaaatcctactatttatgagtcactaagcggtcccgttagggtccctgactcgtcttctctggccctaccaagtctggacacgaaccgccctcccgtgaccgtctcgtgggcctcaagctgaggatggaggctagtatttattactgcagtctctatatgacagcagcagctaaagtcgttacgtttacgggcggtaacgggaccgtaacgcgttacggacccgttccgtcgggtacaacggcccgaaggcctccggcccccgtcggtacctaccg

SEQ ID NO: 306044 - DNA, 518 bp, Homo sapiens
  misc_feature: GZ8MTXP02FN7EC.2.35.D02.1.454.CMB.2.raw
  modified_base (244)..(244): a, c, t, g, unknown or other
  misc_feature (244)..(244): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanaactatgtctcctggtatcaacaacacccccggcgaacgcccccaaactcctcatttatgaggtcactaagcggcccttaggggtccctgatcgcttctctggcctccaagtctggcagaacggccctcctgaccgtctctgggctccaagctgaggatgagctgattattactgcagctcatatgcaggcagcagcaatgtacgtttcggcggagggaccaaagctacgaccgtcctgggtcaagcccaaggctccgccccctcggtctaccg

SEQ ID NO: 306045 - DNA, 582 bp, Homo sapiens
  misc_feature: GZ8MTXP02GIWT9.2.35.D02.1.454.CMB.2.raw
  modified_base (388)..(388): a, c, t, g, unknown or other
  misc_feature (388)..(388): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctgtatcaacacacccggcgaacgacccccaaactcctacatttatgagtcactaagcggtccgttaggggtccctgactcgcttctctgcctcagtctggcacgacgcctcctgaccgtctcgtggctcagcngagatggagctgatttactactgactagtctactattatcgacgagacagacgagtacgtaaattcggtttaacgtttcgggacggggtacgggtaacccgaaaggtccgtacggtacccggttccgtaggggttacccaaccggtaccccgaacggggtccctcccggtccccccgttcggtacccttacccg

SEQ ID NO: 306046 - DNA, 642 bp, Homo sapiens
  misc_feature: GZ8MTXP02F4XEK.2.35.D02.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaccgacccggacgaaccgaccccaaactcctactatttangacggtcaacgtaacggccggtacccgttacggggtcccctgtacgtccgtcttctcgtcggcccctaccgagttcgtcggcaacggacccggtcctccgtcggacccgtcgtcgtcgggcctaccgaacgtcgtaggaacggagtaggacgtacgtagttaactttaagttaacgtcgtacgaacgtccttacgtattacgtcgacgaggaccaggcaacgactagttacgtttacggtttacggacgggtaacggaacgaacggtctaccggaccgtaccgtcggtaccgaaccggaccgaacgggtcctaccggtcccccgtacggtaccttcccg

SEQ ID NO: 306047 - DNA, 540 bp, Homo sapiens
  misc_feature: GZ8MTXP02GA7HR.2.35.D02.1.454.CMB.2.raw
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccccccgcgtccgggtctcctggacagtcagtcaccatctcctgcactggagcagcagtgacgttggcgttataactatgtctcctggtatcaacaacaccccggngaaacgcccccaaatcctacatttacngaggtcactaagccggccttaggggtcccctgatcgcttcntcggctccccaagtctggcagaaccggcctccctgacccgttctcgtgggccttaccgaagctagacggatggaggtctgatttactactgccagctanatanganagnagnagntattcgttacgttcggacggtacggacagcgtacgaccgtcgtacggacacgccgacgcctccgcccgtcgtccaccttc

SEQ ID NO: 306048 - DNA, 577 bp, Homo sapiens
  misc_feature: GZ8MTXP02J0PC3.2.35.D02.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctggtatcaacaacaccccggcaacgccccaaactcctacatttangagtcactaagcggccgttacgggtccctgtactcgtcttctctggcctcaagtctgcagacggcctccgtgaccgtctcgtgggcctccgaaacgcgtagaggagtaggagtcgtgtaatttattaccgtcgtacacgtctactagtatgacgacgacgacgacgagtactagttacgttacgtttcggacggacggacgtaacggtacgtacggaccgtacgtacggtacgaaccggtaccgacggtccgtacccgtcccgtaccgtacctaccg

SEQ ID NO: 306049 - DNA, 699 bp, Homo sapiens
  misc_feature: GZ8MTXP02HE8XN.2.35.D02.1.454.CMB.2.raw
  modified_base (308)..(308): a, c, t, g, unknown or other
  misc_feature (308)..(308): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaaccgaccccggcgaaaccgacccccaaactcctacatttangacggtcaacgtaaggccggcccgttaggggtcccctgactcgcttctctggccctacagtctggcacgaccggccctcctgtaccgtctccgtgggcctaccgaagtccgtacggaggtagtacggaggtacgtaggttaatttaacgttaacgttcgacgtaacggtcctagtaacttacgtcgggacgtaacggggaccaacggacctaagaaccgtaaaggtttacgtttaaaccggttttcggggaaccggggtaaacggggacccgtaaacgggtccgtaaccggttacccggtaccggttccggggttaaccgtaaccggacccccgtaaacggggtaccccgttacccggacccccccggtttacgggtccccttaaccccgg

SEQ ID NO: 306050 - DNA, 578 bp, Homo sapiens
  misc_feature: GZ8MTXP02HISBF.2.35.D02.1.454.CMB.2.raw
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (457)..(457): a, c, t, g, unknown or other
  misc_feature (457)..(457): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctcgccctgactcagcctccctccgcgtccggtctcctggacngtcagtcaccatctcctgcacgtggagcagcagtgacgttggcgttaanaactntgtctctgtatcaacaccacccggacaacgcccccaaactcctactatttangacgtcaacgtaagccggtccgttacggggtccctggactcgtcttctctcgccctcaagtcgtggcaacggacgccctccgtcgaccgtctcgtcggcctaccaagcgtagagagtggaggtctagtaatttattacgtgacagctacgattagngcgaggcagcgagactaagttcggtttacgttcgggacggacggaaccgacgtacgtaccgtaccggtccgtcgggaccaaccggccgaacggtcccgtaccgccccgtcgtacccgtccg

SEQ ID NO: 306051 - DNA, 506 bp, Homo sapiens
  misc_feature: GZ8MTXP02I1OJG.2.35.D02.1.454.CMB.2.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcatggagcagcagtgacgttggcgttataactatgtctctgtatcaacacncccgnaacgccccaaatcctcatttangagtcactaacgcgcccgttagggtccctgactcgcttcnctgcctcagtctgcacgacgcctccngcctctcgtggctcagctgagatgagctagattatatgcagctacattatgacgagcagcagacagttcgtacgtttcgggacggtaggacacgtctcgtaccgtcgtggtacaacggcccgaggcctccgtccccgtcgtcctaccg

SEQ ID NO: 306052 - DNA, 625 bp, Homo sapiens
  misc_feature: GZ8MTXP02G0DNL.2.35.D02.1.454.CMB.2.raw
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (453)..(453): a, c, t, g, unknown or other
  misc_feature (453)..(453): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntntctctgtatcaacaacacccggacgaacgacccccaaactcctactatttatgagtcacgtaagcggtccgttaggggtccctgactcgcttctcgtgccctacgatcgtgcagacgcctccgtgaccgtctcgtggcctacgaagtctaggagacgtggacggtcttaggtatttaagttacgcgaccgtaagtcccttaanagttacgtggaccgaggacccaggaccgaagtacgtaagtttacggtttacggtttaccgggacggggtaaaccgggacctaaacggcgtttaccgacccggtacgttaacggtcgggtaaccgaacccggaccgaacgggtccgtacccggtcccccgttacggttacccc

SEQ ID NO: 306053 - DNA, 525 bp, Homo sapiens
  misc_feature: GZ8MTXP02I5MH1.2.35.D02.1.454.CMB.2.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacattcagtcaccatctcctgcactggagcagcagtgacgttggcgttanaactatgtctctggtatcaacaacaccccggcgaacgcccccaaactcctcatttangaggtcactaagcggccttaggggtccctgactcgcttctctggcctcgaagtcngcacgacgcctcctgacctctcgnggctcagctgagntgngctgattatactgcacgctcatatgcagcagcagactaattcgtacgtttcgggacggtacgggaccaacgcgtcgtaccgtcgtcggtcaacgtacccgaacggcctccggacccctcggtacctaccg

SEQ ID NO: 306054 - DNA, 526 bp, Homo sapiens
  misc_feature: GZ8MTXP02IGGXP.2.35.D02.1.454.CMB.2.raw
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcggttaataactatgtctcctggtatcaaacaacaccccggcaacgcccccaaatcctcatttangagtcactaagcgcccttaggggtccctgatcgcttctctggctcagtctgcagacgcctccngaccgtctcgtggctcaagntgagntgagctgattattacngcagctcatatgcagcagcagacaagtgttacgtttcggacggaacggaccaaacgcttacgacccgtccgtagggtccgaacgcccgaaaggcctacgcccccgtacggtccctaccg

SEQ ID NO: 306055 - DNA, 503 bp, Homo sapiens
  misc_feature: GZ8MTXP02G6QDO.2.35.D02.1.454.CMB.2.raw
  modified_base (417)..(417): a, c, t, g, unknown or other
  misc_feature (417)..(417): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtctgggtctcctggacagtcagtcaccatctcctgcactggagcagcagtgacgttggcgttataactatgtctcctggtatcaacaacaccccggcgaacgcccccaaactcctcatttatgaggtcactaagcgcccttaggggtcctgatcgctctctcgctcaagtctggcagaccggcctccgtgaccgtctcgtgggctcaagctgagatgaggctgattatactgcagctnatatgcagcagcagcaatgtacgtttcggcggtaggacaagctcgaccgtcgtaggtcgacgccgaacgcctcgccccgtcggtcc

SEQ ID NO: 306056 - DNA, 578 bp, Homo sapiens
  misc_feature: GZ8MTXP02HSAAE.2.35.D02.1.454.CMB.2.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctcgcgtccggtctcctggacagtcagtcaccatctcctgcactggagcagcagtgacgttggcgttanaactntgtctctgtatcaacaaccacccggcaacgcccccaaactcctactatttangagtcaacgtaacgcggtcccttaggggtccctgactcgcttcntcgcctcagtctggctacgacgtcctcctcgaccgtctcgtcggctaccaagctaggagagtgacggtctagtatttactacgtgacagtctacattatgacaggcagcagtacgtaattcggttacgtttcgggacggtaacgggaaccaaggtccgtacggtacccggtccgttacggggtaccaacggacccgtaacggtcccgtccggtaccccccgtcggttaccctacccg

SEQ ID NO: 306057 - DNA, 560 bp, Homo sapiens
  misc_feature: GZ8MTXP02IJIZ3.2.35.D02.1.454.CMB.2.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (409)..(409): a, c, t, g, unknown or other
  misc_feature (409)..(409): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcacatctcctgcactggagcagcagtgacgttggcgttataactntgtctctgtatcaacacacccgcaacgcccccaaatcctacatttangagtcactaagcgtccttaggggtccctgactcgcttctctggccctcagtctggcagaaccgcctccctgaccgtctcgtgggctaccagctgagatgagctgtacttagttacngcacgtctatattagcgacgagacgagacacgtactagttacgttacgttacgggacgggtaacggacctaacggtccgtaccgtaccgtaccgtacggtaccgaacggtacccgaacggtccgtacccgtccccgttacggtacctaccg

SEQ ID NO: 306058 - DNA, 708 bp, Homo sapiens
  misc_feature: GZ8MTXP02H8Q3W.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaaacaccaccccggcaacgcccccaaactcctctatttatgagtacactaagccgtcccgttaggggtccctgactcgtcttctcgtcggccctaccaagtctggacaaggaacccggcccttcccgtagtaccccgttctccgttcggggcccttacccgaaagtccgtaggaacggtagtcggaggtccttaggtaactttaacgttaaccgttggacctaacggtcccttacgtaaagtttaagtcgggaccgtaacgggccaacggaccgaagtaaccgttaaaagtttcgggtttaaaaccggttttccgggggaaccggggtaaacggggtaaccgaaaacggtccgttaccgggtaaacccgttccggtacggggtaccctaaccggaaccccgtaacgggcccgtaccccggtccccccggttacgggtaccctaccccg

SEQ ID NO: 306059 - DNA, 561 bp, Homo sapiens
  misc_feature: GZ8MTXP02G0FPA.2.35.D02.1.454.CMB.2.raw
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacaacaccccggacgaacgcccccaaactcctacatttangagtcaactaagcggtcccgttaggggtccctgactcgcttctctggcctccagtctggcagaccgcctcccgtgaccgtctcgtgggcctccgaagctggagagtgagctagtatttatactgcagctacattagtgacgaaggcaggacagacaagttcgttacgtttcgggacgggaacggacctaaggcgtacggtacccgtcgtcgggtaccaacgcccgaacggtccctaccggtcccccgtacggtcctaccg

SEQ ID NO: 306060 - DNA, 514 bp, Homo sapiens
  misc_feature: GZ8MTXP02GJ6NR.2.35.D02.1.454.CMB.2.raw
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (495)..(495): a, c, t, g, unknown or other
  misc_feature (495)..(495): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggagcagcagtgacgttggcgttatactatgtctctggtatcaacaacaccccggcaacgcccccaaactcctcatttangagtcactaagcgccttagggtccctgatcgcttctctggcctcatctgcagacgcctccngaccgtctcgtggctccaagctgacgatgaggctgattattactgctagctactagtatgaccgaggcagcagactaatgttactttcggacggtaggaaccaagctacgaccgtacgtggccaaggcccaaggccnccgccccgtcggctacccg

SEQ ID NO: 306061 - DNA, 582 bp, Homo sapiens
  misc_feature: GZ8MTXP02HA2JX.2.35.D02.1.454.CMB.2.raw
  modified_base (206)..(206): a, c, t, g, unknown or other
  misc_feature (206)..(206): n is a, c, g, or t
  modified_base (295)..(295): a, c, t, g, unknown or other
  misc_feature (295)..(295): n is a, c, g, or t
  modified_base (416)..(416): a, c, t, g, unknown or other
  misc_feature (416)..(416): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntctctgcactggagcagcagtgacgttggcgttataactatgtctctggtatcaacacaccccggcaacgcccccaaatcctcatttangagtcactaagcgtccttagggtccctgactcgcttctcgtgccctccagtctggcagaaccgcctaccgtgaccgtctcgtgggcctaccgaagctgaggatggagctgatttagttacngtcagtcctagattagagccgaggccaggccaggtactaagttcggtttaacgtttccggggacggtaacggggacctaaacgggcttacggacccgttcgtaccggggtaccaacgggaccccgtaacggtccttacccggtcccccgtcgggttaccctacccg

SEQ ID NO: 306062 - DNA, 566 bp, Homo sapiens
  misc_feature: GZ8MTXP02I31F0.2.35.D02.1.454.CMB.2.raw
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctgtatcaacaacaccccggcgaacgcccccaaactcctactatttatgagtcaactaagccggtcccgttaggggtccctgatcgcttctcgtgcctcagtctggcacgaccgcctcctgaccgtctcgtcgggctccaagctgagatgagctgtattattacgngactagctanattgcgacgagacagacagactaagttcgttaccgttcgggacgggacggtaccgacggtcgtaccggtaccgtcggtcggtaccaaccggtacccgaacggtcccgtacccggtcccccgttacggtacctaccg

SEQ ID NO: 306063 - DNA, 618 bp, Homo sapiens
  misc_feature: GZ8MTXP02JPMC1.2.35.D02.1.454.CMB.2.raw
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttataactatgtctctggtatcaacaaccaccccggacgaaccgcccccaaaactcctactatttacgngacgtacaacgtaacggccggtaccggttacgggtccctaggtactcgtcttctcgtgcccctacagtcgngcacgaccgtccctcctacgaccgtcgtcgtcggcctaccgaagtcgtaggagtacgtaggacgtcgttagtaactttaacgttacgtacgaccgtacgtcttactaaattcgtcgacgtacggcacgacgtagactaagtttcgttacgttcgggacggaacgtaccacggtcgacgtaccgtccgtgggtaccaaccgtacccgaaggcccgtacccgtcccgtcggtacctcccg

SEQ ID NO: 306064 - DNA, 553 bp, Homo sapiens
  misc_feature: GZ8MTXP02F9NIF.2.35.D02.1.454.CMB.2.raw
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
  modified_base (371)..(371): a, c, t, g, unknown or other
  misc_feature (371)..(371): n is a, c, g, or t
  modified_base (419)..(419): a, c, t, g, unknown or other
  misc_feature (419)..(419): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccntctcctgcacgtggaggcagcagtgacgttggcgttataactntgtctctgtatcaacacacccggcaacgccccaaactcctacatttangagtcactaagcgtcccgttagggtccctgatcgtcttctcgtcggcctaccagtctggcacgaaccgcctccngtaccgtctcgtggcctccaagctgacgatgagtctgtattattacgngcagtctatatagcgacgacgacgagacaagtactagttcgttacgttacgggacggacggtaccacggtccgtacgtaccgtcgtacggaccaaccggtacccgacgtccgtcccgtcccgtacgtacctccg

SEQ ID NO: 306065 - DNA, 602 bp, Homo sapiens
  misc_feature: GZ8MTXP02H7OB7.2.35.D02.1.454.CMB.2.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctcctgcactggagcagcagtgacgttggcgttanaactntgtctctgtatacaacaaccacccggcgaacgacccccaaactccctctatttacngtacggtcaacgtaacgccggtacccgttacggggtccctagacttccgctttcctcgtcggtccctccaagttcncggacacggtaaccgccctccgtcgacccgttctcgtcggcctacaacgtctcgaggactaggagtcttacgtatttacttacgtcgactaagtcttactattagtcgacgacggcagcagactaagttgttaccgtttacgggacggtacggaccgtaacgtcgtacgtaccgtcgtacggtcaaccgccgaacggtcctccggtacccctcggtacctccg

SEQ ID NO: 306066 - DNA, 503 bp, Homo sapiens
  misc_feature: GZ8MTXP02IPOMZ.2.35.D02.1.454.CMB.2.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (331)..(331): a, c, t, g, unknown or other
  misc_feature (331)..(331): n is a, c, g, or t
  modified_base (360)..(360): a, c, t, g, unknown or other
  misc_feature (360)..(360): n is a, c, g, or t
  modified_base (487)..(487): a, c, t, g, unknown or other
  misc_feature (487)..(487): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaggcagcagtgacgttggcgttataactatgtctctgtatcaacacacccgnaacgcccccaaatcctcatttangagtcactaagcgcccttagggtccctgatcgcttcnctggcctccagtctggcagaacgcctccngaccgtctcgtggctccagctgagatgagctagattattactgctagctacatatgcaggcagcagctaagtgtaacgtttcggacggtagggaccaagctacgacgtcgtgggtcaagccgagtcncgcccctggtcctacg

SEQ ID NO: 306067 - DNA, 539 bp, Homo sapiens
  misc_feature: GZ8MTXP02JDBWB.2.35.D02.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggagcagcagtgacgttggcgttanaactntgtctcctggtatcaacacaccccggcaacgcccccaaactcctcatttangagtcactaagcgtccttaggggtccctgatcgcttctctggcctccagtctggcagaacgcctccngaccgtctcgtgggctccaagctagagntgagctgattatacgngcagtctnatgtgacgacgnacgacagactagttcgttacgttcggacggtacgacgacgtcgtacggtacccgtcggtacggtaccaacggacccgacggtccgtaccgtccccgtacggtcctacg

SEQ ID NO: 306068 - DNA, 576 bp, Homo sapiens
  misc_feature: GZ8MTXP02F33FA.2.35.D02.1.454.CMB.2.raw
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaaacaaccaccccggcgaacgcccccaaactccctacatttangaggtcaactaacgccggtcccgttaggggtcccctggactcgtcttctcgtggcctccagtctggcagacggcctccngaccgtctcgtgggcctcaagtctagaggatcgagtctagtattattactgcacgtctacatagtcgacgaggcagcagactaagttcgttaacgtttcgggacggtacgggaaccaaacggtccgtacggtacccgttccgtcgggtaccaacgacccgaaggtccctccgtcccccgtcggtacctacccg

SEQ ID NO: 306069 - DNA, 581 bp, Homo sapiens
  misc_feature: GZ8MTXP02JXVPR.2.35.D02.1.454.CMB.2.raw
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaacaacaccccggcgaacgccccaaactcctcatttangagtcactaagcgccttaggggtccctgactcgcttctctggcctcagtctcggcacgaacggcctccctgaccgtctcgtcgggcctccgaagcctggacggatggaggtctgtatttattactgcagctacgatatgcaggacagcaagctaaagttcggttaacgtttcgggacgggtaacgggaccgaacggtacgtacggtacccgttccgtacggggttaccgaacggtaccccgaacggtcccgtaccggccccccgttacgggtccctacccg

SEQ ID NO: 306070 - DNA, 510 bp, Homo sapiens
  misc_feature: GZ8MTXP02IVZH0.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctggtatcaacaacacccggcaagcccccaaatccctcatttangaggtcactaagcggcccttagggtccctgatcgcttctctggcctccagtctggcagaacgcctcctgaccgtctcgtgggctcagctgagatgagctgattatactgcagctcatatgcaggcagcagacatgtacgttttcggacggtaggactaaacgcgtcgaccgtccgtggtcaacgcccgaagcctcgcccccgtcggtctaccg

SEQ ID NO: 306071 - DNA, 533 bp, Homo sapiens
  misc_feature: GZ8MTXP02JCMY6.2.35.D02.1.454.CMB.2.raw
  modified_base (296)..(296): a, c, t, g, unknown or other
  misc_feature (296)..(296): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacacacccggcaacgccccaaactcctacatttangagtcactaagcgtccttagggtcctgactcgcttctctgccctcagtctggcagacgcctccgtgaccgtctcgtggcctcgaagtcgtacgagagtgaggtctgtaattacgttactcgacgtagtctacatagtgtacgaggacacgacagtcgtaagttcgtacgtttcggacggtaggaaccgacgctacgaccgtcgtcggtacgaacgccgagcctccgccctcgctccg

SEQ ID NO: 306072 - DNA, 536 bp, Homo sapiens
  misc_feature: GZ8MTXP02IETYZ.2.35.D02.1.454.CMB.2.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgcctgactcagcctcctcgcgtccggtctcctggacagtcagtcacatctctgcactggagcagcagtgacgttggcgttanaactntgtctctggtatcaacaacacccggnaacgcccccaaactcctcatttangtagtcactaagccgtaccgttaggggtccctgatcgcttcnctggcctccagtctgcagacgcctccngacctctctggctcanctgagntgagctgattatctagcagctcattagtncgagcagcagtcaagttcgtacgtttcgggcggaacggaccgaaagtcgtacggtaaccccgttcggtcggtaccgaacggtacccgaaggtcccgtaccggcccccgttacggtcctaacccg

SEQ ID NO: 306073 - DNA, 602 bp, Homo sapiens
  misc_feature: GZ8MTXP02FRP21.2.35.D02.1.454.CMB.2.raw
  modified_base (342)..(342): a, c, t, g, unknown or other
  misc_feature (342)..(342): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctctggtatcaaacacaccccggcgaacgcccccaaactcctcatttatgaggtcactaagcggtcccttaggggtccctgatcgcttcnctggcctccagtctggcagacgcctccngacctntctggctcaagctgaggatgagtctgattattactgcagcctcatacgtgacagggcaaggcaaggacaaagttcggtttaaaccgttttcgggggaccgggtaaacggggaacccaaaacggtccttacggtaaccccggtttcccgtcgggggttacccgaacggtaccccccgaaaaggggtccccttcccggacccccccgttacgggttccctaaccccgg

SEQ ID NO: 306074 - DNA, 585 bp, Homo sapiens
  misc_feature: GZ8MTXP02G6AEH.2.35.D02.1.454.CMB.2.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (447)..(447): a, c, t, g, unknown or other
  misc_feature (447)..(447): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatctcctgcactggagcagcagtgacgttggcgttataactntgtctctgtancaacacacccgcacnccccaactctcatttngagtcacgtaacgccggtccgttacgggtccctgtactcgcttctcgtgccctcagtctggcacgaccgcctccgtcgccgtctcgtcggctacccgaagcgtagacgtataggacggtctagtattacgttacgtgactacgctactatacgnggacgaggacagacgtagactaagtttcggttaaccgtttcgggaacggtacggtaaccaacggtcgtaccggtacccgtcggtacggtaccgaaccgtaccgtaacgcccgtcccgaccccgttcggtacttacccg

SEQ ID NO: 306075 - DNA, 536 bp, Homo sapiens
  misc_feature: GZ8MTXP02JGCYV.2.35.D02.1.454.CMB.2.raw
  modified_base (250)..(250): a, c, t, g, unknown or other
  misc_feature (250)..(250): n is a, c, g, or t
  modified_base (401)..(401): a, c, t, g, unknown or other
  misc_feature (401)..(401): n is a, c, g, or t
  modified_base (502)..(502): a, c, t, g, unknown or other
  misc_feature (502)..(502): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaggcagcagtgacgttggcgttataactntgtctctggtatcaacacaccccggcaacgcccccaaactcctctatttatgaggtcactagccggcccttaggggtccctgattcgcttctctcggcctccaagtctggcagacgcctccctcgaccgtctcgtggcctcaagctgagangagctgattatactgcagctactattatggacgaaggccagcagactaagtcgttacgtttcgggacggtacggaccaagcgtacgaccgtcgtgggtacncgcccgaaggccctcgaccccgtcggtcctaccg

SEQ ID NO: 306076 - DNA, 545 bp, Homo sapiens
  misc_feature: GZ8MTXP02GRVHV.2.35.D02.1.454.CMB.2.raw
  modified_base (249)..(249): a, c, t, g, unknown or other
  misc_feature (249)..(249): n is a, c, g, or t
  modified_base (345)..(345): a, c, t, g, unknown or other
  misc_feature (345)..(345): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (416)..(418): a, c, t, g, unknown or other
  misc_feature (416)..(418): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcacgtggagcagcagtgacgttggcgttatactntgtctctgtactcaacaaccaccccggcaaccgcccccaaactcctatatttatgagtcactaagccggtccgttagggccctgactccgtcttcnctcggccctaccgagtctggcacgacgcctccngcctncgtcgctcagctagagntgagctagtattactnnntacgntcattngcgagacgngacagactagttacgtttacgttcgggacgacggtactaacgctacggaccgttcggacggtaccaacggaccgacggtcctcccggccccgttacggtacctcccg

SEQ ID NO: 306077 - DNA, 585 bp, Homo sapiens
  misc_feature: GZ8MTXP02ISMAK.2.35.D02.1.454.CMB.2.raw
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacacccggacaacgacccccaaatcctacatttangagtcactaagcggtccgttagggtccctgatcgctttctctggtccctaccagtctggcacgaaccggtcctccctcgtaccgttcctcgtcgggcctccgaaagtcgtggagacgtgagtctagtattagttacgtgactagtctactattagtgacgaggacaggacaacgcgtaaattgttacgtttcggggacggacgggtacaaacgtcgtacggtacccgtccggtcggtccgaacggcccgaaacggtcctcccggtcccccgtcggttacctacccg

SEQ ID NO: 306078 - DNA, 722 bp, Homo sapiens
  misc_feature: GZ8MTXP02J2MRN.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttatactntgtctctggtatcaacaaccgaccccggacgaacgcccccaaactcctactatttagtgacggtcaactaaggccggtcccgttacggggtccctgtactcgtcttctcgtcggtccctaccgaagttccgtaggccaacggtaacccgggtccccttaccccgtacggtacccccggttcttccgtcggggtacccttacccgaaacgtccgttaaggacgggtattacgggagggtactaggtaacttttaacgtttaaccgttgaccgtacgtacctactaatacgtacgacccggaagggacacggtaccgaagtaacctaaaggtttcgttaacccggtttacggggacgggtaaaccgggaccgaacggtaccgttaccggacccgttccggtccggggtaaacccgaacccggtaacccggtacggtccccgttaccccggtacccccgttaccggtcccgtacccg

SEQ ID NO: 306079 - DNA, 533 bp, Homo sapiens
  misc_feature: GZ8MTXP02HSS5Z.2.35.D02.1.454.CMB.2.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
tcagacgctcgacacacgaccggtgctcgatttagcacacgatagttgggttttgggggtctcaggaggcagcgctctcaggacgtcaccaccatggcctgggctctgctcctcctcaccctcctcactcagggcacagggtcctgggcccagtctgccctgactcagcctccctcgccgtccgggtctcctggacagtcagtcaccatctcctgcactggagcagcagtgacgttggcgttataactatgtctcctggtatcaaacaacaccccggacgaacgaccccccaaactcctacatttangtacgtcaactaagcgtccgttaggggtccctgatcgctttctctcgcctaccagtcgtggcagaacggcctcctnaccgtctcgtcgggctccaagctgagatgagctgattatatgcagctnatatgcagcagcagcattcgtacgtttcggacggtacggacaaacgcgtacgaccgtcgtcggtcaacggccgaacggcctcgtccccgtcggtacctaccg

SEQ ID NO: 306080 - DNA, 588 bp, Homo sapiens
  misc_feature: GZ8MTXP02FW4LD.2.35.D02.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (436)..(436): a, c, t, g, unknown or other
  misc_feature (436)..(436): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaccaccccggcaacgaccccaaactcctactatttangaggtcaactaaggccggtcccgttagggtccctgactcgcttctcgtgccctcagtctcggcaacggaccggcctccgtcgacctctcgtcgggcctccgaagctaggagagtggagtctagtatttacttacgngtactagcctatattagtcgacgacgacaggaccagtactaagttagtttaccgttcgggacgggaacggacaacggtcgtaccgtacccgtcgtcgggtaccgaacggacccgtacggccccgtccgtcccccgttacggtcccttacccg

SEQ ID NO: 306081 - DNA, 624 bp, Homo sapiens
  misc_feature: GZ8MTXP02IJHI7.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggcgttanaactntgtctctgtatcaacacacccgcgaacgcccccaaactcctactatttangtacggtacacgtaagccggtaccgttacggggtccctgactcgcttctctggccctaccaagtctggcacgaacgcctacctgtacccgtctcgtgggctccgaagtcagagntaggagtctagtattatacgtgactagtctanattagtcgacgaaggcacgacgaagtaccgtaaagtttcggtttaaccgttttacggggacgggtaaacgggaacctaaacggtcccgttaccggtaacccggttccgttaacgggggtacccaacggtaccccgtaaacggtcccgtaccccggtcccccgttacggtaccttaaccccg

SEQ ID NO: 306082 - DNA, 541 bp, Homo sapiens
  misc_feature: GZ8MTXP02JKHIN.2.35.D02.1.454.CMB.2.raw
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctcctggtatcaacaccaccccgtntaacgcccccaaatcctcatttangaggtcactaagcgccgttagggtccctgactcgcttcnctgccctcagtctggcagacgcctccngacctcncgtggcctcaagctgagatgagctgatttagtactgcagctacatangacgagcagcagactaagtgttaacgtttcgggacggtacgggaccaaaggccgtacggacccgttcgtagggtaccaacggacccgtaacggccgttccgaccccgttcggtacctacccg

SEQ ID NO: 306083 - DNA, 619 bp, Homo sapiens
  misc_feature: GZ8MTXP02HAFXR.2.35.D02.1.454.CMB.2.raw
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
  modified_base (494)..(494): a, c, t, g, unknown or other
  misc_feature (494)..(494): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacggttggcgttataactntgtctctgtatcaacaaccgaccccggacgaaccgacccccaaactccctactatttacgngtacggtcaacgtaacgccggtccgttacggggtccctgactcgtcttctcgtgcccctacgaagtcgtaggactaacggaccggtccctaccgtcgtacccgttcgtccgtcgggcctaccgaagcgtaggagactggacgtactagtaatttacgttacgcgtacgactctactattacgngacgacgcgagacagtacttaagttcgttacggttacgggacggaacggactacggtcgtaccggtaccgtaccgtacggaccgaaccgtaccgacggtcccgcccgtcccgtacgtaccctccg

SEQ ID NO: 306084 - DNA, 544 bp, Homo sapiens
  misc_feature: GZ8MTXP02G77X0.2.35.D02.1.454.CMB.2.raw
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttataactntgtctctgtatcaacaacaccccggcaacgcccccaaatcctcatttangagtcactaagcgccttgggccctgactcgcttcncgtgcctaccgagtctggcagaaccggcctccngaccgtctcgnggctcagctagagagtgagtctgtaattattaacgtgtactctntaatagtgacagggcagcaacgntaagtcgttacgtttcgggacgtacgggaccagtcgtacggaccgtcggtacggtcacgtaaccgaacggtcctccggtcccccgtcgtaccaccgtttccg

SEQ ID NO: 306085 - DNA, 586 bp, Homo sapiens
  misc_feature: GZ8MTXP02GMRI8.2.35.D02.1.454.CMB.2.raw
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctcctggtatcaaacaacaccccggcgaacgccccccaaactcctacatttangagtcactaagcggccttaggggtccctgatcgcttcnctggccctcagtctggcagacgcctccgtgacccgtctcgtcgggcctaccgaagcgtaggaggatggaacggtctagtatttaacttactacggctaggtcttacattagtgacgtaggacacggacaggactaaagttcgttacgtttacgggacgggtacgggtaccaacggtccgtacggtacccgttcgtgggtcaacggacccgaaggtcccgtaccgcccccgttcggtcctaccg

SEQ ID NO: 306086 - DNA, 536 bp, Homo sapiens
  misc_feature: GZ8MTXP02FUNU3.2.35.D02.1.454.CMB.2.raw
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcaggcacagggtcctgggcccagtctgccctgactcagccctccctccgcgtccgggtctcctggacagtcagtcaccatctctgcactggagcagcagtgacgttggcgttataactatgtctcctggtatcaacaacaccccggcgaacgccccaaactcctcatttangagtcactaagcgtccgtagggtccctgactcgcttctctggcctcagtctgcacgaccgcctcctgaccgtctctgggctccaagctgagatgagtctgtattatactgcagtctcatatgcagcgagacgagactaagttcgtacgtttcgggacggtacggaccaaacgcgtacgtaccgtccgtgggtaccaacggacccgaacggtcctaccggccccgtcggtcctacccg

SEQ ID NO: 306087 - DNA, 688 bp, Homo sapiens
  misc_feature: GZ8MTXP02ICSM1.2.35.D02.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcacgtggagcagcaggtgacgttggcgttanaactntgtctctgtatcaacaccaccccggacgaacgaccccaaactcctactaatttatgacggtaccaacgtaacggccggtacccgttaacggggtcccctaggtacttccggtcctttccgtcgttcgggtacccccttaccgtaaacggtcgttacgggacgaacggaacccgggcccccttaccgtcggtacccgttccgtccgttcggggacccttaccgaaacgttccgtaggaacggtaacgttggaaccgggttacgttaacggttaactttaacgtacgtacgacgtacgtactacgttaacgtacgtacgtacgtacgtacgtacgacgtacgtacgtagttcgttacgtacggacggtacgacgtacgtcgtacgtacgtcgtacgtacgaacgtaccgtacgtccgtccgtacccgtacgtaccgtccg

SEQ ID NO: 306088 - DNA, 598 bp, Homo sapiens
  misc_feature: GZ8MTXP02ITAC7.2.35.D02.1.454.CMB.2.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (360)..(360): a, c, t, g, unknown or other
  misc_feature (360)..(360): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgtatacatntctctgtatcaacaacncccggcgaacgccccaaactcctnatttangagtcactagcgccgttaggtccctgactcgcttctctgcctccagtcgtgcacggacgcctcccngtaccgtctcgtcggctcaacgctaggacgtagtgacggctagactttagttactgcagtctagtactatcgcgaacggccaaggcgaacgactaaagtttacgtttccggtttacggtacgggggtaacgggacctaaacggtccgtaacgggtaccccgttccggtacgggtaccgaaccggaaccccgtaacgggtcccgtacccggtccccccggtttcggtaaccctttcccg

SEQ ID NO: 306089 - DNA, 601 bp, Homo sapiens
  misc_feature: GZ8MTXP02HE61R.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttanaactntgtctctgtatcaacacacccggcaacgccccaaactcctcatttangagtcactaagcgtaccgttagggtccctgactccgtcttcgtcgtcggccctaccgaagttcgtacggacacggaaccggtcccctcccgttacgacccgttccgtcgtcgggcctaccgaagcgtggacgagtggagtctagtattaactgtgacagtctacattaacgcgacgaggccagacgacgacttaagttcgtttaaccggtttcgggaaccgggtaacggacccaaaggtccgtacgtaccggtccgtcggacaaccgtacccgacggtcccgtcccgcccccgttacggacttcccg

SEQ ID NO: 306090 - DNA, 630 bp, Homo sapiens
  misc_feature: GZ8MTXP02JZOQ8.2.35.D02.1.454.CMB.2.raw
  modified_base (249)..(249): a, c, t, g, unknown or other
  misc_feature (249)..(249): n is a, c, g, or t
  modified_base (383)..(383): a, c, t, g, unknown or other
  misc_feature (383)..(383): n is a, c, g, or t
  modified_base (462)..(462): a, c, t, g, unknown or other
  misc_feature (462)..(462): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactntgtctcctggtatcaacaacaccccggcgaacgcccccaaactcctcatttatgagtcactaagccggcccttaggggtccctgactcgtcttctgtcgcctccaagtctggacaggaaccggccctacccgtntacccggtctcgtcgggcctcccgaaagtccgtaggaggtagtggacgggtctgtaattacttactgactagctctaanacgcgacgacgacgacgacgacgtacgtaacgttacgtttacggtttacgggtacgggtaacgggaccgaacggtaccggtaccggtacccgtaccggtaccgggtaccggaaccggtacccggtaccggtcccgtccccggtcccccggtcccggtacccgtacccg

SEQ ID NO: 306091 - DNA, 549 bp, Homo sapiens
  misc_feature: GZ8MTXP02HW60G.2.35.D02.1.454.CMB.2.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttatactntgtctctgtatcaacaaccacccggcaacgcccccaaactcctcatttangagtcaactagcgtccgttagggtccctgatcgcttcncgtcgcctcagtctgcagaacgcctcctgaccgtctcgtggctaccgagtctaggacggatgagtctagtattatacngacagtctacattagtgacgaggaccaggacaacggtactaaagttcggtttacgtttcggggacggaacggtaccaagtcgtacgtaccgtcgtaggtccaacgccgacggtcctccgccccgtcggtactacccg

SEQ ID NO: 306092 - DNA, 616 bp, Homo sapiens
  misc_feature: GZ8MTXP02IO43Z.2.35.D02.1.454.CMB.2.raw
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgccgtccgggtctcctggacagtcagtcaccatctcctgcacgtggagcagcagtgacgttggcgttanactntgtctctgtancaacacnccggcacnccccaatccnctatttangagtcaacgtaacgccggtacccgttacggggtccctgactccgtctttcgtctcgccctaccgaagtcgtggacaacggacccgtccctccgtcgaccgtctcgtggcctcgaagctggacgntggagtctagtaatttagttacngcagtctacattagngtacgacggctaacgacgagtaacttaggttacgtttacggtttcggggaacgggtaacgggacctaacgggtccgtacgggtacccggtcggtttacgggaccgaacggtacccgaacgggtcccctacccggtacccccggttcggtaccttaccccgg

SEQ ID NO: 306093 - DNA, 538 bp, Homo sapiens
  misc_feature: GZ8MTXP02GBBND.2.35.D02.1.454.CMB.2.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccggcaacgccccaaactcctcatttangacgtacactaacgcggtccgttacggggtccctgatcgtcttctcgtgccctcacgtctgcacgaacggcctccgtcgaccgtctcgtcggctccagctgagangagctgatttatacgtgctagctcatngcgagtcagcagactaagttcgtacgtttcggacggtaacggacacggtcgtacgtaccgttcgtcgggtacaacgtacccgaacggcctccgtaccccgtcggtctaccg

SEQ ID NO: 306094 - DNA, 620 bp, Homo sapiens
  misc_feature: GZ8MTXP02HO904.2.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggcgttanaactntgtctctgtatcaacaaccacccggcaacgccccaaactcctctatttatgagtcaacgtaacggccggtaccgttacggggtccctgtactcgtcttctcgtcggcctaccaagtcgtcgcacggaccgtcctcccgtgacccgtctccgtcgggcctaccgaagtccgtaggacgtagtggaacggtcttaggtaattttaacgtacgtggactacgtcctactacttagcgaccgaggcacgcgaagtctaaagtttcggttaacgtttcggggacggaacgggtaccaaacggtccgtaccggtacccgtacggtggtaccaacggacccgaacgggtccctaccggtcccccgtcgttcccgtacccg

SEQ ID NO: 306095 - DNA, 637 bp, Homo sapiens
  misc_feature: GZ8MTXP02JXGBD.2.35.D02.1.454.CMB.2.raw
  modified_base (309)..(309): a, c, t, g, unknown or other
  misc_feature (309)..(309): n is a, c, g, or t
  modified_base (437)..(437): a, c, t, g, unknown or other
  misc_feature (437)..(437): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctaactcagccctccctccgcgtccgggtctcctggacagtcagtcaccatctcctgcactggagcagcagtgacgttggcggttataactatgtctcctggtatcaacaaccgaccccggacgaaccgcccccaaactcctactatttangaggtccacgtaacgccggtcccgtttaggggtcccctgtactccgtcttcctcgtcggcctacccgagtcgtggacacgaccggccctccgtcgaccgtctccgtcggcctaccgaagctaggaggngtaggacggtcgtagtaatttacttacgtcgtacacgtactactattacgtgacgacgggcaacggctagactaagttcgttaaccggtttcgggaccgggtacgggtaccaacggtccgtacggacccggttccgtacggtacccgacggaaccccgaaggtccctcccggtcccccgtacggtcccgtacctttcccg

SEQ ID NO: 306096 - DNA, 707 bp, Homo sapiens
  misc_feature: GZ8MTXP02JE7QI.2.35.D02.1.454.CMB.2.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggagcagcagtgacgttggcgttataactntgtctcctggtatcaacaacaccccggcgaacgcccccaaaactccnccattttaangtacgtacaactacggccggtccgttacgggtccctgactcgtcttctcgtcgtccctaccgtacgtcgtcggacgaacggaccgtcccttcccgtcgtacccgttccgtcgtcgggtcctacccgtaacgtcgtaggaaggtacgtaggtacggtcttagtaactttaacgttacgtacgaccgtagtaccttactaagttacgtcggtacgaacggaccgacgacgtaacgaccttaaacggtttacgggtttaaccggtttcggggaacggggtaacgggtaaacccgtaaacggtccggttacccgggtacccggttacccggttacggggtaccaacccgggtaccccgtaaacgggtcccgttaccccgtacccccggttaccggttacccttacccg

SEQ ID NO: 306097 - DNA, 573 bp, Homo sapiens
  misc_feature: GZ8MTXP02GLY7H.2.35.D02.1.454.CMB.2.raw
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggcaacgcccccaaactcctacatttangagtcaactaagccggtcccttaggggtccctgatcgcttcnctgcctccagtctggcagacgcctccngaccgtntcgtggctccagctgagatgagctgattatactgacagtctcatactgacaggcagcagactaagttcgttaacgttttcgggacgggaacgggtaaccaaaggtccgtacggtaccccggttccggtacggggttaccaacggtaccccggaaacgggtcccgtcccggtaccccccgttcgggtacccttacccg

SEQ ID NO: 306098 - DNA, 615 bp, Homo sapiens
  misc_feature: GZ8MTXP02I2CYO.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttaataactatgtctcctggtatcaaacaacaccccggagaacgccccaaaactcctacatttaanagagtacaactaaggccgtaccgttacgggtccctgtactcgtcttctcgtcgccctacagtcacgacaacgaacgtcctcctacgaccgtctcgtcggtcctacgaacgtcgtaggaggtagtgagtacgtagtaattaattaacgtagtacgtacgtactactaatagtagtacgacgacgacgacgacgtaacgtaacgttacgttacgtttacggtacgggtaacgggaacgtaaacgtacgtacgtaccgtaccgtacggtacgtaacgaccgaacgtaccgtaccgtcccgtaccgtaccgtacg

SEQ ID NO: 306099 - DNA, 635 bp, Homo sapiens
  misc_feature: GZ8MTXP02JKRYT.2.35.D02.1.454.CMB.2.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacacccgcaacgccccaaactcctctatttangtagtcactaagcggcccttaggggtccctgtatcgtcttctctggccctaccagtctcggcacgaaccggcctccctcgaccgtctcgtcggcctccaacgcgtaggacgagtggaacggtctaggtaattttactacgtgactacgctacataagtcgacgaaggcacggacaagacctaagttacggtttacgtttacggggaccgggtacgggaaaccgaaacggtcccgtacgggtacccggttacccggttcgggggtaccaacccgggtaccccggaaaacggtccccggtttaccccggaccccccggttaccgggtaccctttacccccgg

SEQ ID NO: 306100 - DNA, 538 bp, Homo sapiens
  misc_feature: GZ8MTXP02IPIR9.2.35.D02.1.454.CMB.2.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagacgctcgacacacgaccggtgctcgatttagcacacgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctccngcactggagcagcagtgacgttggcgttaanaactntgtctcctgtatcaaacaacaccccggcaacgaccccaaactcctacatttangagtcaactaagcgcccgttagggtccctgatcgtctctctggcctcaagtctggcagaacggcctccctgacccgtctctgggcctaccaanccgtagagatggaagctagattattacgngnanctanatangacgagacagacagactagttacgttacgttcggacggacggacacgcgtacgtaccgtcgtacggacgaacgacccgaacggcctccgcccgtacgtctacg

SEQ ID NO: 306101 - DNA, 624 bp, Homo sapiens
  misc_feature: GZ8MTXP02HDEAP.2.35.D02.1.454.CMB.2.raw
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcacgtggagcagcagtgacgttggcgttataactntgtctctggtactcaacaaccaccccgacgaaccgacccccaaactcctactatttanggacgtacactaaggccggtacccgttaggggtccctgactccgtcttctcgtgccctccagtcgtgacacgaccgtccctccgtacgtacccgtctcgtgggacctaccgaagcgtggacgtagtggacgtcttagtaactttactacgtcggactacgtctacacgtagtcgacgacggacacgacgaacgtctaaagttcgtttacggttcgggaacgggacgggaccaacggttcgtaccggtacccgtcgtaccggtaccaaccggtaccgacggtcccgtacccggtccccgtacggtaccctttaccg

SEQ ID NO: 306102 - DNA, 570 bp, Homo sapiens
  misc_feature: GZ8MTXP02HXW0Y.2.35.D02.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgcactggagcagcagtgacgttggcgttataactntgtctcctggtatcaacaacaccccggcaacgcccccaaactcctcatttangaggtacaacgtaacgcggtcccgttaggggtccctgactcgcttcnctcggcctacagtctggcacgacgcctcctgaccgtcgtcgtggctcccgagctacgaggctgaggtctgtatttactacgtgcgatctacattatcgacaggcagcacgactaaagtcgttacgtttcgggacggtacgggtacccaaggtcgtacgtaccggtcgtacgggtacgaaccgtaccgaacggtcccgtacgtcccccgtcgggtaccctaccg

SEQ ID NO: 306103 - DNA, 682 bp, Homo sapiens
  misc_feature: GZ8MTXP02GDL8H.2.35.D02.1.454.CMB.2.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcaggggacagggtcctgggcccagtctgccctgactcagccctccctccggcgtccgggtctccgtggacagtcagtcaccatcctcctgcacgtggagcagcagtgacgttggcgttanaactntgtctctgtatcaacaccgaccgacgaacgaccccaactcctactattangacgtacaacgtacgccggtccgtttacggggtcctgtactcgtcttctcgtcggtcctacccgtaagtcgtcggtacgaacggaacccgtccctcccgtcgtacccgttcgtccgtcggggcctaccgaaacgtcgtaggacggtagtacggaggtccgttagtaactttaacgttacgtcgtacacgtactacgtaatacgtagacgacggacacgacaacgtacgtaaacgttcggtttaaccgtttacggggaccgggtaacgggtaaccgtaaacggttccggtaccggtacccggttccggtacgggtaccgaaccggaacccggtaacggtcccgtacccggtcccccgttcggtaccctacccgtttcccg

SEQ ID NO: 306104 - DNA, 575 bp, Homo sapiens
  misc_feature: GZ8MTXP02HGAB2.2.35.D02.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgggagcagcagtgacgttggcgttanaactntgtctctgtancaacacacccgnaacnccccaatccntattangagtcactagcggtcctagggtccctgatcgtcttctctggccctccagtcgngcacggaccggtccctcccgtgaccgtcgtcgtcgggcctaccgaagtccgtagaggtacgtggaggtctagtaatttacttacgtgaccgtagtcctacgtagttagcgacgacgcgagacgagtactagttacgttacgtttcgggacggacggtaccgaaacggtcgtacggaccgtcggttaggaccgaacggccgacggtcctcccgccccgtcggtacctccg

SEQ ID NO: 306105 - DNA, 606 bp, Homo sapiens
  misc_feature: GZ8MTXP02H6DQD.2.35.D02.1.454.CMB.2.raw
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctcctggtatcaacaaccaccccggacaacgcccccaaactcctactaatttangtaacggtcaacgtaaagccggtacccgttaacggggtcccctgtactccgtctttctcgtcggccctaccgaagtcgtggcaacggaccggccctcccgtgacccgttctcgtcgggcctaccgaagtccgtaggaggtaacgtggaggtctagtaatttaacttacgtcgacgacgtcctactaattaagcgacgaggccaaggaccagactaaagttcgttacgtttcgggacggacggacaagtcgtacgaccgtcgtggacaacgaccgaacgctccgccccgtcggtactaccg

SEQ ID NO: 306106 - DNA, 592 bp, Homo sapiens
  misc_feature: GZ8MTXP02H86CC.2.35.D02.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacaacnccccggacaacgcccccaaactcctactatttangaggtcaactaaggccggtaccgttacggggtccctgactcgtcttctctcggccctaccgaagtcgtggactacggaaccggcccttcccgtagacccgttctccgtgggtcctaccgaagcgtgaggactggagtctgtattattactgcagctacgattatgacaggcagcagtacaattgttacgtttcgggacggtacggaaccgtaaacgccgtacggtacccgtcgttacgggacaacggacccgtaaacggtcccgttaccgcccccgtcggtaccctacccg

SEQ ID NO: 306107 - DNA, 586 bp, Homo sapiens
  misc_feature: GZ8MTXP02IURDI.2.35.D02.1.454.CMB.2.raw
  modified_base (245)..(245): a, c, t, g, unknown or other
  misc_feature (245)..(245): n is a, c, g, or t
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggagcagcagtgacgttggcgttatactntgtctctgatcaacacacccggnaacgcccccaaactcctcatttangagtcactaacgcggtacccgttaggggtccctgacttcgtcttctntcggcctccagtctggcacggacgtcctcctcgaccgtctcgtggctcgagctagagacgtgagctagtatttagtactgacgtagtctacatacgtcgacgaacggcacgcaggtactaaagtttcgttaacgtttcgggacgggtacgggaaccaaggtccgtacggacccggttcgtcggggtaccaacggaccccgtaaacgggtcccgtaccggtaccccccgttcggtacccgtttacccg

SEQ ID NO: 306108 - DNA, 771 bp, Homo sapiens
  misc_feature: GZ8MTXP02GUJXP.2.35.D02.1.454.CMB.2.raw
  modified_base (247)..(247): a, c, t, g, unknown or other
  misc_feature (247)..(247): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttataactntgtctctggtactacaacaaccaccccggacaaaccgaccccccaaactccctactaatttactaggacggtaccaacgttaaacggccggtaccccgtttacggggtcccctagaacttccgtctttcctccgtcggtccccttacccgaagttccgtcgggaccgaaacggtaaccccgggtcccctttacccccgtacggtaacccccgtttccgttaccggttcgggggtacccttaacccgaaaggtcccttaggggaaacgggacttagggaacgggtcttaggttaatttaacgtttaccgtgaccgtaagccttactaagtttaatcggacgaagggacctaggaccaggtaacctaaaagttttcggtttaaaccgggtttttcccgggggacggggtaaaccggggaaacccttaaaggtcccggttacggtaaccccggttccggtacggggtacccaacggtaccccgaaacggggtccctacccggtacccccgtcggttacctaccccgg

SEQ ID NO: 306109 - DNA, 565 bp, Homo sapiens
  misc_feature: GZ8MTXP02H3QHW.2.35.D02.1.454.CMB.2.raw
  modified_base (247)..(247): a, c, t, g, unknown or other
  misc_feature (247)..(247): n is a, c, g, or t
  modified_base (395)..(395): a, c, t, g, unknown or other
  misc_feature (395)..(395): n is a, c, g, or t
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctctgcactggagcagcagtgacgttggcgttataactntgtctctgtatacaacaccacccggcgacgcccccaaactcctcatttatgagtcaacgtaagccggtacccgttacggggtccctgatcgtcttctctggccctccagtctggcagaccgcctcctcgaccgtctcgtcggctcganctgagatgagctagtattatactgcagctacattngacgaggcagcagtactaagttcgttacgtttcgggacggaacgggaacccgaagtcgtacggtacccgtccggtcgggtaccgaaccggacccgaaacgggtccgtacccggtcccccgtcggtaccctacccg

SEQ ID NO: 306110 - DNA, 639 bp, Homo sapiens
  misc_feature: GZ8MTXP02F9ZR5.2.35.D02.1.454.CMB.2.raw
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctctgcacgtggaggcagcagtgacgttggcgttataactatgtctcctggtatcaaacaaccaccccggcgaacgcccccaaactcctacatttangaggtcactaacgccggtcccgttaggggtccctagactccgtcttctcgtcggccctaccgaagtcgtacggcgaacgaaccggtcctccctggacccgttccgtcgtcgggaccttaccgaagccgttaggagaatggaacgtctagtatttaacgttacgtgacaggtactacaattacgtcgacgaacggcgaacgtacaaggtaacttaagtacgtttaccgtttacggggacggtacgggaaactacggcgttacggaccgttaccggtcggtaccgtaaccggacccgaaggtccctacccggtaccccgttcggtacctttacccgg

SEQ ID NO: 306111 - DNA, 629 bp, Homo sapiens
  misc_feature: GZ8MTXP02I8L84.2.35.D02.1.454.CMB.2.raw
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (469)..(469): a, c, t, g, unknown or other
  misc_feature (469)..(469): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactgggagcagcagtgacggttggcgttataactntgtctctgtatcaacaccacccggacaaccgacccccaaactcctactatttacgngacgtacacgtaacggccggtaccggttacgggtccctgacgttccgtcttctcgtcggtccctaccagtcgtcgacgacgacccgtccctccgtcgaccgtcctcgtcggcctccgaagtctaggacgagtgagcttagtatttactacgtgctagctanattagcgacgaggcagacgtagacttacgttacggtttacggttacggaacggtaaacggaaccgtacggtaccgtacggtacccgttccggtacggtaccgaaccccggtacggtaaccggtcccgtaccccggtccccgttacggtacccctttcccg

SEQ ID NO: 306112 - DNA, 607 bp, Homo sapiens
  misc_feature: GZ8MTXP02JP9K1.2.35.D02.1.454.CMB.2.raw
  modified_base (306)..(306): a, c, t, g, unknown or other
  misc_feature (306)..(306): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttatactatgtctcctgtatcaacaccaccccggcgaaccgacccccaaactcctactattttacngacgtcaactaaggcggtcccgttacgggtacccgtgactcgcttctcgtcgccctcagttcgtcgcacgaccgcctcctgtaccgtctcgcggtcnccagctggagtagtgacgcgtagtattagttcacgtctacgactanagtagtgacgagccagaccgtagaccgtaagtttacggtttaccgtttacgggaccggggaacgggtaacaaccgggtcgtacggtacccgttccggtacggtaccgaaccggacccgtaacggtcccttacccggccccggttccggtaccttcccg

SEQ ID NO: 306113 - DNA, 589 bp, Homo sapiens
  misc_feature: GZ8MTXP02HE66U.2.35.D02.1.454.CMB.2.raw
  modified_base (305)..(305): a, c, t, g, unknown or other
  misc_feature (305)..(305): n is a, c, g, or t
  modified_base (470)..(470): a, c, t, g, unknown or other
  misc_feature (470)..(470): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtgacgttggacgttataactatgtctctgtatcaacaccgacccggacaacgacccccaaactcctactatttangtacgtacactaacgccggtaccgttacggggtccctagactcgcttctcgtgcccctacacgtctggacaacggaccgtcctacccgtgcccgtctcgtcggcctacccgagcgtaggaggagtacggagtctagtatttactacgtgacagtctactaattgncgaggacagactagactagttacgttacggttcggacgggtacgaacgacgtcgtacggaccgttcgggtacggaccaaccggaccgtacgtcctacccgtccccgtcgtaccctcccg

SEQ ID NO: 306114 - DNA, 525 bp, Homo sapiens
  misc_feature: GZ8MTXP02IRL27.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaggcagcagtgacgttggcgttataactatgtctctgtatcaacacacctggcgaacgcccccaaactcctcatttatgagtcactaagcggccctttaggggtccctgactcgcttctctgctcagtctgcagacggcctcctgacctctctgggctccgaagctgacggatgaggctgatttatactgacagctacatatcgacagcagcagctaagtgtacttttcggacggtacggacgaaacgcgtcgaccggtccgtcggtaacgacgaccgaacggcgtaccgccccgttacggtcccg

SEQ ID NO: 306115 - DNA, 613 bp, Homo sapiens
  misc_feature: GZ8MTXP02IHHN2.2.35.D02.1.454.CMB.2.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctcgcgtccggtctcctggacagtcagtcacatctctgcacgtggagcagcagtgacgttggcgttanaactntgtctctgtatcaacacacccgnaacgccccaaactcctcatttacngacgtcactaagcgtaccgttagggtccctgactcgtctcctcgtcggcctacctaacgtctagggctaacggaaccggtcctcccgtgtacccgttcctcgtcgggccttacccgaagtcnggtaaacgggngtaggacgtacttagttaatttacgtacgtcgacgtacgtcttactagtacgtacgacgacgacgacgtacacgtactagttcgttacggttacgggacggacggtacctacgtaccgtacggtacccgtacggtcggtaccgaaccggtaccgtacggtcccgtaccggtccccgtacgtaccctacg

SEQ ID NO: 306116 - DNA, 733 bp, Homo sapiens
  misc_feature: GZ8MTXP02HLMJ7.2.35.D02.1.454.CMB.2.raw
  modified_base (311)..(311): a, c, t, g, unknown or other
  misc_feature (311)..(311): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttataactatgtctcgtgtatccaaacaaccgaccccggacaaccgacccccaaactcctactaattttanggaacggtaccaacgtaacggcccggtacccggttacggggtcccctagtacttccgtctttctcgtcggacccctaccgtaagtcgtagggtaccaacgggtaaccccggtccccttaccccgtacggtacccccgttccgtccggttcggggtacccttacccgaaacgggtcgttacggaagggtaagttcgggaacgggtccgtttaggttaaacttttaacttacgttcggactaacggtaccttacgtaagtttagtacggacggtacggacgacgacgtacgtaacgtagtttacggttacggttccgggaacgggtaccggacgtaacggtccggtaccggtacccggtcggtaccggtaccgaaccggacgtaccggtcccgtaccccggtcccccggttcgtacccttcccg

SEQ ID NO: 306117 - DNA, 533 bp, Homo sapiens
  misc_feature: GZ8MTXP02FM4Y3.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtatcaacacaccccggacgaacgccccaaactcctacatttangagtacactaagcggccttaggggccctgactcgcttctcgtgccctaccaagtctggacagacgcctccngaccgtctctgggcctacagctgagatgagctagtattatactgcagctacgattagngacgaggccagcgatacaagttcgttacgtttcggacggtacgggacaacgcgtacgaccgtcgtggtacaacgccgaacggtcctccgtccccgtcggcctaccg

SEQ ID NO: 306118 - DNA, 582 bp, Homo sapiens
  misc_feature: GZ8MTXP02FU8TT.2.35.D02.1.454.CMB.2.raw
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactntgtctctgtatcaacacacccggcgaacgcccccaaactcctactatttangaggtcacgtaagcggtccgttacgggccctgatcgcttctcgtgccctaccagtctgacagaccgtcctcctgaccgtctcgtggctccaagcgtagacgagtgagtctgtattacgttactgctagctactatatgacaggaccaggacagtacgtaagttacgtttacggttttacgggacgggtacgggaaccgtaacgtccgtacggtacccgttcggtacgggtaccgaaccggacccaacggtcccgtaccggtcccccgtcgggtaccttaccccg

SEQ ID NO: 306119 - DNA, 637 bp, Homo sapiens
  misc_feature: GZ8MTXP02F2TEW.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttatactatgtctctgtatcaacaaccacccggacgaaccgacccccaaactcctactatttatgaacgtcaacgtaacgcggtcccgttacggggtccctgacttcgcttctctcggcccttaccgtaacgtctacggtcaacgaaccggtccctacccgtcgacccgttcctcgtcgggccctacgaaacgtcgtaggagtacgtggagtctagttaactttacgttaacgtcgactaacgtcttacgtaattagtcgacgaaggccaagcgaagactaagttcggtttaacgttcgggacggggtaacggaaccgaaacggtcgtacccggtaccgttccggtcggtaccaacgccccgaacggtcccgtccgtcccccgtggtacccttcccg

SEQ ID NO: 306120 - DNA, 539 bp, Homo sapiens
  misc_feature: GZ8MTXP02JLMQM.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (489)..(489): a, c, t, g, unknown or other
  misc_feature (489)..(489): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtatcaacaacaccccggcgaacgcccccaaactcctcatttangagtcactaagcggtccttaggggtccctgactcgcttctctgcctcagtctgcagacgcctcctgaccgtctcgtggcctccgaagctagagatgagctgattagtactgcagctacatatgacaggcagcagcaaagttgttaacgtttcgggacggacggggaccaaaggccgttacgacccgttcgnggggtaccaacggcccgtaaagggcccttccgcccccgtcggtcctaccc

SEQ ID NO: 306121 - DNA, 690 bp, Homo sapiens
  misc_feature: GZ8MTXP02G3FN4.2.35.D02.1.454.CMB.2.raw
  modified_base (471)..(471): a, c, t, g, unknown or other
  misc_feature (471)..(471): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggagcagcagtgacgttggacggttatactatgtctctgtatcaacaaccgaccccggacgaacgaccccccaaactcctactaatttacgagtaacggtcaacgtaacggccggtacccgtttaacgggggtcccttgaactcgtcctttcctcgtcggtccctaccgtagtccgtaggaccgtaacggaaccggtcccttcccgtcggacccgttcgtacgtcggggtacctacccgaagtccgtaggaaggngttaggacggtacttggtaacttttactaacgtggactacggtaccttacaatttgaccggacgtacgacgacggactaacgtacgttaacgtttcggtttacgggttaccggggacggtaacggaacgtacggtcgttaccggtacccgtcggtacgggaccgtaaccggacccggtacggtaccccggtacccgtaccccggttacgtacctacccg

SEQ ID NO: 306122 - DNA, 665 bp, Homo sapiens
  misc_feature: GZ8MTXP02JNPO2.2.35.D02.1.454.CMB.2.raw
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
  modified_base (507)..(507): a, c, t, g, unknown or other
  misc_feature (507)..(507): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcgttatactntgtctctgtatcaacaccacccggacgaaccgacccccaaactcctactatttanaggtacgtcaacgtaacggccggtacccgttacggggtccctagactcgtcctttctcgtcggcccttaccgaagttcgtaggcaacggaccgtccctccgtcggtacccgttcgtcgtcgggaccttaccgaaacgtcgtaggacgtaagtcggaacggtcttagtaactttacgttacgtgacctaggtccttaagagttacgngacgacgacaacggacaacgtacgtaacgtttaccggtttacggttacggggacggtaacggaaaccgtacggtaccggtacggtacccggtcggtacggaaccgaaccggacccggtaacggtcccgtacccggtaccccgttacgtacccgtaccg

SEQ ID NO: 306123 - DNA, 568 bp, Homo sapiens
  misc_feature: GZ8MTXP02FT85I.2.35.D02.1.454.CMB.2.raw
  modified_base (445)..(445): a, c, t, g, unknown or other
  misc_feature (445)..(445): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttataactatgtctctgtatcaaacaacacccggcgaacgcccccaaactcctcatttatgaggtcaactaaggccggtcccgttaggggtcccctggactcgtccttctctcggccctaccaagtctgggacaacggaaccggccctcccgtcgaccgttctccgtcgggctaccaagctaggagatgagctgactttattacngctagctctatatcgacgaggaccaggcagactaagttcgttacgtttcgggacggtacggacgaacgtcgtcgaccgtcgtcgggtcaacgcccgaaggtcctcgccccgtcggtactaccg

SEQ ID NO: 306124 - DNA, 659 bp, Homo sapiens
  misc_feature: GZ8MTXP02GEB0B.2.35.D02.1.454.CMB.2.raw
  modified_base (298)..(298): a, c, t, g, unknown or other
  misc_feature (298)..(298): n is a, c, g, or t
  modified_base (384)..(384): a, c, t, g, unknown or other
  misc_feature (384)..(384): n is a, c, g, or t
  modified_base (468)..(468): a, c, t, g, unknown or other
  misc_feature (468)..(468): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctgtatcaacacacccggacaacgccccaaactcctactatttangtagtacactaagccggtaccgttaggggtccctagtactccgctttctcgtggccctaccaagttcaggcaacgacggccctccngtaccgtctcgtggctccaagcctgagatggacgtctacggtaatttaacgttacgtcgacgtaacgtcctactaagtttaacncggtaccgaagggaccgaacggacaacggtaccgttaaagtttaccgggtttacgttttaccgggggaacgggttaaacggggaaccgtaaacgggtccgttaacggtaccccggttaccggtcgggttaccgaaccggtacccgaaacgggtcccttacccggtcccccgttcgggaccctttaccccgg

SEQ ID NO: 306125 - DNA, 609 bp, Homo sapiens
  misc_feature: GZ8MTXP02FR30W.2.35.D02.1.454.CMB.2.raw
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttaataactntgtctctgtatcaacaaccaccccggcaacgacccccaaactcctacatttangagtcaactaagccggtcccgttaggggtcccctgactccgtcttctcgtcggccctaccaagtcgtaggcctaacggaaccggtccctcccgtcgtacccgttcctccgtggggcctacgaacgtctaggagatggagctagtatttactctagcagtctatatatgaccgaggaccagacagactaagttcgtttaacggtttcggggacgggaggtaacccgaggccgttacggtacccgtcggttacggaccgaaccggcccggaacggtccgtaccccggtcccgtcggttaccctcccg

SEQ ID NO: 306126 - DNA, 660 bp, Homo sapiens
  misc_feature: GZ8MTXP02F1M33.2.35.D02.1.454.CMB.2.raw
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (458)..(458): a, c, t, g, unknown or other
  misc_feature (458)..(458): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctcctggtatcaaacaacaccccggngaaacgcccccaaaatccctacattttaangacgtcaactaaggccggtaccgttacggggtccctgactccgtcttctcgtggcccctaccaagtcgtggacaacggaaccgccctccgtgtaccgttctcgtcggtcctacgaagtctaggaggatggacgcttagtaatttattacgngacagtactactatagtagacgaggacgacgacgacgtaacgtaacgttacgtttacggtttaccgggtacggggtaaccggggtaaaccggtaaacggtaccggtaaccggttaacccggttaccggttacgggtaccggaaccggtaacccggaaaccggtaccggtacccggtacccccggtacccggttaccgtaccg

SEQ ID NO: 306127 - DNA, 525 bp, Homo sapiens
  misc_feature: GZ8MTXP02FR3PE.2.35.D02.1.454.CMB.2.raw
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
  modified_base (507)..(507): a, c, t, g, unknown or other
  misc_feature (507)..(507): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctggtatcaacaacaccccggcgaacgacccccaaaactccctacatttactgacggtacaactaagcggtcccttaacggggtccctgactcgcttctctggcctccaagtctggcagaacggcctcccngaccgtctctggctcaagctgagatgagcagattatactagcagctcatntagcgaggcagcagcaagtcgtacgtttcggacggaggaacagcgtagacccgtctggtcaagcccaaggtccncgacccctcggtctaccg

SEQ ID NO: 306128 - DNA, 586 bp, Homo sapiens
  misc_feature: GZ8MTXP02I70IU.2.35.D02.1.454.CMB.2.raw
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaaccaccccggngaaacgcccccaaactcctcatttangagtcaactaagccggtccgttaggggtccctgactcgtcttctcgtcggcctccgaagtctggcaacggaaccgcctcccgtgacccgtctcgtcgggcctaccaagcgtagagatggaagtctagtatttatactgcagtctcatatgacaggcagcagacaagttcgttaacgtttcgggacgggtaacgggaaacccaagggtctacggtacccggtaccgtcggggtaccaacggacccgaaggtcccgtcccggcccccgttacggtaccttaacccg

SEQ ID NO: 306129 - DNA, 549 bp, Homo sapiens
  misc_feature: GZ8MTXP02FLIJJ.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctctgtatcaacaacaccccggcaacgacccccaaactcctactatttangagtcactaagcgtccgttagggtccctgatcgcttctctggcctccagtctggcagaacgcctcctgaccgtctcgtggcctccaagctgagatggaggtctagtatttagttactgcagcctacatatgacgaggcagcagactaagtcgtttacgtttcgggcgggtaacggaccaaagtccgtacgacccgtcgtcgggtaccaacggtcccgaggcctcccgaccccgtcggtacctacccg

SEQ ID NO: 306130 - DNA, 654 bp, Homo sapiens
  misc_feature: GZ8MTXP02H7FG3.2.35.D02.1.454.CMB.2.raw
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (442)..(442): a, c, t, g, unknown or other
  misc_feature (442)..(442): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaggcagcagtgacgttggngttanactntgtctctgtancaacaaccacccggcaaccgacccccaaactcctactatttatgacgtcacgtaacggccggtacccgttacggggtccctgtactccgtcctttctcgtcggtcccctaccgaagttcgtcggacgacggaacccgcccttcccgtcgaccgtcctccgtcgggcctccgaagtcgtaggagngtaggagtctagttatttacttacgtcgctaggtactatagttacgcggtacggaggacgaagaccgaagtaacgttaagtttcggtttaccggtttacgggggaacgggtaacgggacctacgggtaccgtacggtaccggttccggttcgggtacaaccgggacccgtacggtcccgttcccggtcccccggttacggtccctttaccgg

SEQ ID NO: 306131 - DNA, 640 bp, Homo sapiens
  misc_feature: GZ8MTXP02F7KQN.2.35.D02.1.454.CMB.2.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggcgttataactntgtctctgtancaacacacccgacgaacgccccaactcctactatttangagtcaactacgccggtcccgttaggggtccctgactcgtcttctcgtggcctccaagtcgtacggcgacgaaccgtccctccgtacgaccgtctccgtcgggcctaccgaagcgttaggaggagtggacggtctacgtagtttaacttacgtacgacgtacgtctactagttacgtgacgacggacgacggcgtaacgtacgtaaagtttcggtttacgtttcggggacggggtaacgggtaaaccgaaacggtccgtaccgggtaccgttacccggttacgggaccgaaccggtaccccgaacggtcccgtccccggtccccgttacggtcccttacccg

SEQ ID NO: 306132 - DNA, 606 bp, Homo sapiens
  misc_feature: GZ8MTXP02HRKOM.2.35.D02.1.454.CMB.2.raw
  modified_base (248)..(248): a, c, t, g, unknown or other
  misc_feature (248)..(248): n is a, c, g, or t
  modified_base (355)..(355): a, c, t, g, unknown or other
  misc_feature (355)..(355): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcatggagcagcagtgacgttggcgttataactntgtctctgtatcaaacaacaccccggcaacgcccccaaatccacatttatgagtcactaagcgaccgttagggtccctgatcgcttctcgtgcctacagtcgtcggnacggaacgcctcctgaccgtctcgtggctccgaagctagagatgagtntatattatngacacgtctatagtagngacgagacgacgacgacgtacgtaacgttacgtttacggtttacgggtacggggtaacgggtaaccggtaacgtaccgtaccggtacccggttacccggttaccggtaccggtaaccggtacccggtaaccggtacccggtacccggtaccccggttacccggttacccgttacccg

SEQ ID NO: 306133 - DNA, 589 bp, Homo sapiens
  misc_feature: GZ8MTXP02JOZ6G.2.35.D02.1.454.CMB.2.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (434)..(434): a, c, t, g, unknown or other
  misc_feature (434)..(434): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttatactatgtctcngtatcaacacacccgnaacgcccccaaactcctactatttangtacgtacaactagccggtccgttacggggtccctaggactcgtcttcncgtgccctcagtcnggcacgacgcctcctgaccttcncgtcggctcgatcgtgagatcggagtctagtattactacgtgactatctanaattgcgaccaggcagcgacgtactaagttcgttacgtttcgggggacggtaacggacccgaaacggtccgtaaacggtacccggttccgtacggggtaccaacgggacccgtaacggtccgttccccggtaccccgttacggttccttaccccg

SEQ ID NO: 306134 - DNA, 701 bp, Homo sapiens
  misc_feature: GZ8MTXP02IJBN2.2.35.D02.1.454.CMB.2.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatcnctgcactggagcagcagtgagttggacgttataactatgtctccgtgtatacaaacaaccacccggacgaacgaccccccaaatccctactatttangtacggtacaacgtaaggccggtacccgttacggggtccctaggactccgtcttcctcgtcggtaccctaccgaagtctaggcacgaccgtccctccgtagaccccgttcctaccgtcggggacctaccgaacgtcgtaggacggtaagtcgggtaaaggcttaagggtaactttaacgtttaacgtacgtaccgtaacgtacccttaagtacgttaacgtacggaccggtaacggtacgacgaacgtaaggaaccttaagtttacggtttaaccgttttaccggggaacgggtacgggtaaaccgtacgtaccgtacggttacccggtaccgttacgggtaccaacggtaaccccgaagtccccgtaccgtcccccgttacggtacccttacccg

SEQ ID NO: 306135 - DNA, 594 bp, Homo sapiens
  misc_feature: GZ8MTXP02F93SM.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (388)..(388): a, c, t, g, unknown or other
  misc_feature (388)..(388): n is a, c, g, or t
  modified_base (448)..(448): a, c, t, g, unknown or other
  misc_feature (448)..(448): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactntgtctctgtactcaacaaccaccccggcaaccgacccccaaactcctactatttangacgtcaactaacggccggtcccgttaggggtcccctgactcgtcttctctcggtccctcagtcgtggcacgaccggcctcccngtaccgtctcgtcggctaccagctagagatgagtctgtattatactgcagtcctatatangacgaggcagacagtacagttacgttacgtttacgggacggaacggaccgaacgtccgtacggtacccgttccggtacggggtaccaaccggacccggtaaacggtcccgtaccccggtcccccgttaccgggtacctttaccccg

SEQ ID NO: 306136 - DNA, 571 bp, Homo sapiens
  misc_feature: GZ8MTXP02GVFP1.2.35.D02.1.454.CMB.2.raw
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcacgtggaggcagcagtgtacgttggcgttataactntgtctctgtatcaacaccgacccgnaacgacccccaaatcctatatttagngacgtcaacgtaagccggtaccgttagggccctgactcgtcttcncgtgccctacagtctaggcagacgtcctccgtgccgtcgtcgacggcctacgagctagagtactgacgtntagttattacgtacgngactacgtctacgtatacgacgacgacgacgagacgagtacttaggttcgttacgtacgggacggtaacgaccgtacgtcgtacgtaccgtcggtacggtacaacggtaccgacgtccgtacccgtcccgtcgtactccg

SEQ ID NO: 306137 - DNA, 591 bp, Homo sapiens
  misc_feature: GZ8MTXP02JUFOZ.2.35.D02.1.454.CMB.2.raw
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctggtatcaacaaccgaccccggcgaacgcccccaaactcctacatttangagtcactaagcggtccttaggggtccctgactcgcttctctcggcctccagtctaggcacgacggccctccgngacccgtctcgtcgggcctaccgaagcctaggaggataggngtctagtaatttagttacngcaaggctactactagtcgacgaggcagacagtactaagttcgttacgtttcgggacgggtaacggaccaacggtccgtacggtacccgtccggtacggtacgaaccggtacccgaacggccctcccggcccccgttcggtacccttacccg

SEQ ID NO: 306138 - DNA, 587 bp, Homo sapiens
  misc_feature: GZ8MTXP02GHR7T.2.35.D02.1.454.CMB.2.raw
  modified_base (275)..(275): a, c, t, g, unknown or other
  misc_feature (275)..(275): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactatgtctctggtatcaacaacaccccggngatcgacccccaaactcctacatttatgagtcactaagcggtcccttaggggtcctgactcgcttctctcgctacagtctgcagaccggcctccgtgaccgtctcgtcgggcctccaagtcgtagaggatggaggtctagtatttacttacgtgacagctacgtatagtcgacgagcgagcgagactaagtacgttacgtttacggggacggtacgggtaaccgaaacggtccgtacggtaacccgtccggttacggggtaacgaaccggtacccgaacgggtcccgtacccggtcccccgtaccggttccc

SEQ ID NO: 306139 - DNA, 541 bp, Homo sapiens
  misc_feature: GZ8MTXP02FHE6C.2.35.D02.1.454.CMB.2.raw
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggcgttanactntgtctctgtatcaacacaccccggacgaacgcccccaaactcctcatttangagtcactaagccggtccgttaggggtccctgactcgctctctggcctcagctgcagacgcctccngaccgtctntggctcagctgagntgagcngattatcgngcngctanatgcgacgagcagcagtactaagttcgttacgttacgggacgggtacggacctaacggtcgtaccggaccgttccggcggtaccgaaccgacccgtaacggtccgtcccggtccccgtcgtaccgtaccg

SEQ ID NO: 306140 - DNA, 574 bp, Homo sapiens
  misc_feature: GZ8MTXP02FW7LF.2.35.D02.1.454.CMB.2.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttataactntgtctctgtatcaacaacacccgcaacgaccccaactcctacatttangagtcactagcggtccgttagggccctgactcgcttctcgtgccctcagtctgcacgacgcctcctgaccgtctcgtcggcctacgacgctcggagtacgtggaggtctagtactttacttacgtcgactacgtctacgtattagtcgacggaacggccgaggacagtactagttacgttacgtttcgggacggtacggaactaacgtcgtacggtaccgtcgtcggtaccgaacgacccgaacggtcccgtaccggtccccgtcggtacttacccg

SEQ ID NO: 306141 - DNA, 723 bp, Homo sapiens
  misc_feature: GZ8MTXP02GAHIP.2.35.D02.1.454.CMB.2.raw
  modified_base (243)..(243): a, c, t, g, unknown or other
  misc_feature (243)..(243): n is a, c, g, or t
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanaactatgtctctgtactcaacaccgacccggcaaccgacccccaaactcctactatttanagacgtacaacgtaacggccggtacccgttacggggtccctgacttcgtcctttctcgtcggcccctaccgtaagtcgtgacacggaacccgtccttcccgtaggtacccgttccgtccgtcggggtaccctacccgaaacgtccgttaagggaggtaacgtgggtacgggtacttaggttaatttacgtttacgcgtctaagtcctaactattacgcgacgacggacgaacgacgacgtaacgttaagttccggtttaacggtttccggggacgggtaaaacgggttaaccgaaacgggttccggtaccggttaaccccggttcccgggtacggggttaccccgtaaccggtacccccggaaacgggttcccccgttacccccggttacccccggtttccggtaccctttaacccccgg

SEQ ID NO: 306142 - DNA, 733 bp, Homo sapiens
  misc_feature: GZ8MTXP02F0LX5.2.35.D02.1.454.CMB.2.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagcctccctcgcgtccgggtctcctggacagtcagtcacntctctgcacgtggagcagcagtgacgttggcgttataactntgtctcgtgtactacaacaccgacccggacaaccgaccccctaaatccctactaattttacgacggtacggtacctaaacgtaacggcccggttaccccggtttacggggtccccttaggacgttccgtacctttctcgtcggtacccctaccgtaagtcgtcggacgacggtaaccgtcctaccgtcggtaccgttcgtcgtcgggacctaccgaagtccgtaggaggtacgtacggacggtactaggttaatttacgttacgtacgcgtaacgtcctatacgttagtacgacggaacggacaacggacaacgtacgtaagtttaccggttacgggtttacgggaacgggtaaccgggtaaccgtaaacggttccggttaaccggtaacccggtttccggtaacgggggttacccaaccgggtaaccccggtaaaccgggtccccgttccccggtacccccggttcgggttaaccctttccccgg

SEQ ID NO: 306143 - DNA, 709 bp, Homo sapiens
  misc_feature: GZ8MTXP02GEY6O.2.35.D02.1.454.CMB.2.raw
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatctcctgcacgtggagcagcagtgacgttggcgttatactntgtctctgtatcaacaccacccgcaacgcccccaaactcctacatttangagtcacgtaacgccggtaccgttacgggtccctgtactcgtcttcgtcgtcggcccctaccgtaagttccgtagggtaccaacgggtaaacccggtccccttacccgtacggtacccgttccgtaccgtcggggacccttaccgaaacgtcgtaacggacggtagttcggaacgggtcttaggttaactttaaacgttaccgtgaccgtaagtcccttacgttaagtaacgttacggacgtacggacccaaggacgtaacggaacttaacgtttacggtttaccggtttacgggaccggggttaaacgggaacctaaacggttccgtacggtaccccgggttacgtacgggtaccgaaccggtacccgaaggttcccctacccggtcccccgtacgggtcccttaacccg

SEQ ID NO: 306144 - DNA, 626 bp, Homo sapiens
  misc_feature: GZ8MTXP02JCJV7.2.35.D02.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (310)..(310): a, c, t, g, unknown or other
  misc_feature (310)..(310): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagcagcagtgacgttggcgttanaactntgtctctgtatcaaacaccgaccccggcgaaaccgcccccaaactccctactaactttagnggtaacgtccaacgtaacggccggtcccgttaaggggtccctgacttcgcttctcgtgccctacagtctgacacggacgcctccgcgaccgtctcgcggcctacagcgtggagagtggagtctagtatttactacgtgtactacgtctactaagttagtcgacgaggaccagacgacgtactaaggttacgtttacgtttacggggacgggtaacgggtacccgtaaacggtcgtaccggtacccggttccgtaccgggttacgaaccggtacccgtaacgggtccctccggtcccccgttacggtcctttacccg

SEQ ID NO: 306145 - DNA, 715 bp, Homo sapiens
  misc_feature: GZ8MTXP02GPW32.2.35.D02.1.454.CMB.2.raw
  modified_base (250)..(250): a, c, t, g, unknown or other
  misc_feature (250)..(250): n is a, c, g, or t
  modified_base (309)..(309): a, c, t, g, unknown or other
  misc_feature (309)..(309): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggagcagcagtgacgttggacgttataactntgtctcgtgtactacaaacaccgacccggacaaccgacccccaaactcctactatttanggacgtacaacgtaacggccggtacccgttacggggtccctagacttccgtcttccgtcgtcggtcccctaccgaagttcgtacggaccaacggtaacccggtcccttacccgtacggtacccgtcgttccgggtcgggtaccctacgaaaggtccgtaggacggtaagttgggaacgtcgttagtacttttaacgttcgaggactaacgtcttactagttacgacgaccggtaggaccacggtacgaacgtacgttaaatttcgggtttaacggttaccggggacgggtaaacggaaaccgtaacggtccggtaaccggttacccggtacggttccgggaaccgtaaccggaacccgaacgggttccccgtacccccgtaccccgtccggttaacctttaccccg

SEQ ID NO: 306146 - DNA, 673 bp, Homo sapiens
  misc_feature: GZ8MTXP02G0I6S.2.35.D02.1.454.CMB.2.raw
  modified_base (308)..(308): a, c, t, g, unknown or other
  misc_feature (308)..(308): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcggttataactatgtctcgtgtatacaacaaccaccccggacgaaccgaccccctaaactcctactatttanagtacgtcaacgtaacgccggtccgttacggggtccctgactcgtcttcctcgtcgccctaccaacgtcgtacggactaacggaacccggtcccttccctacggtacccgttcgttccgtacgggtcccttacccgaaacgtccgttaggacggaacgtgggaacggtccgttaggttaatttaacgttaccgtgacgtacgtctactaagttagtcgacggaggaccagaccgagtacgttaaacgttcggtttacgtttcgggacgggtaacggacctaaacggtccgtacggtacccggtacgtacgggtaccgaacggacccgaacggtcccgtacccgtccccgtacggtccttaccccg

SEQ ID NO: 306147 - DNA, 680 bp, Homo sapiens
  misc_feature: GZ8MTXP02JM7B2.2.35.D02.1.454.CMB.2.raw
  modified_base (308)..(308): a, c, t, g, unknown or other
  misc_feature (308)..(308): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctaacctgcactggagcagcagtgacgttggcggttataactatgtctcctggtatcaacaaccaccccggacgaaccgcccccaaactcctacatttangagtcactaacgccggtccgttaggggtcccctgacgttccgctttctcgtcggtccctacctaacgtctcggctacggaccgtcctcccgtcgtaccgttcctcgtcgggcctaccgaagcctaggacgatggaggtctaggtatttaacttacgtcgtacgaacgtccttactaagttagtcggtacgaaagggtccaagggtaccctaaggacctaaaggtttacggtttaccgttttaccggggacggggtaacggggtaaacctaaacgggtcccgttacgggaccccgtttccggtcggggttaccaaccggtaccccggtaaacggtcccgtacccggtccccccggttcgggtacctttacccg

SEQ ID NO: 306148 - DNA, 551 bp, Homo sapiens
  misc_feature: GZ8MTXP02FNXQ5.2.35.D02.1.454.CMB.2.raw
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (508)..(508): a, c, t, g, unknown or other
  misc_feature (508)..(508): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttaataactatgtctcctggtatcaaacacaccccggcaacgcccccaaatcctntatttangagtcactaagcgtcctaggggtccctgatcgcttcncgtgcctccaagtctggcacgaacggccctcctgacctctcgtcgggctcaagctaggagntagagtcngtattatactgcngctcgatactgacgagcgancaagactaagttgttacgtttcgggacggtacggaacaacgtcgtacgtacccgtcgtcgggtaaccncggaccccgaaggtccctccggtccccctcgggtccttacccg

SEQ ID NO: 306149 - DNA, 584 bp, Homo sapiens
  misc_feature: GZ8MTXP02IDTJ2.2.35.D02.1.454.CMB.2.raw
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagacgctcgacacacgaccggtgctcgatttagcacacgatagttgggtttgggggtctcaggaggcaggcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctgtatcaacacaccccgngaacgcccccaaatcctcatttangaggtcaactaagcgtccttaggggtccctgactcgcttcnctggccctccagtctggctagacgcctcctgaccgtctcgnggctccagcngagangagctagattatactgcagtctacattagcgcgaggcagcaggtacctaagttcggttaacgttttcggggacgggaacgggtaaccaaacgggtccgttacggacccgggtaccgttcggggtacctaaccggtaccccgaaacgggcccgtttaccggtaccccccgtttcgggtacccgttaccccg

SEQ ID NO: 306150 - DNA, 606 bp, Homo sapiens
  misc_feature: GZ8MTXP02FVZH0.2.35.D02.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (403)..(403): a, c, t, g, unknown or other
  misc_feature (403)..(403): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctctggtatcaacaccaccccggacgaacgacccccaaactcctacatttangaggtcacgtaacgcggtaccgttaggggtccctgactcgtcttctcgtgccctcagtctgcagacgcctcctgaccgtctcgtggcctcgagctgagangagtcatattatactgcagtctcaagtagtgacgtacggcaggcaacgtacgtaaagttcggtttaccggtttacgggacgggtaacggaaaccgtaaaggtccgtacggtaacccggtttcccgtacggggaccctaaccgggtaacccggaaacggttaccccgtacccggttaccccccgtcgggtttaaccctcccccg

SEQ ID NO: 306151 - DNA, 559 bp, Homo sapiens
  misc_feature: GZ8MTXP02JRE7B.2.35.D02.1.454.CMB.2.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctggtatcaacaacacccggngaacgcccccaaactcctacatttactgacggtacactaagcggccttaggggtccctgactcgcttctcgtgccctccaagtctggcacgaacggcctcccgtgacccgtctcgtacgggctcgaagctgagagtgaggctgtaattagttactgcagctactatactgacgagacagacagtacaacttgttacgtttcgggacggacggaccgtaacgcgtacgtaccgtccgtagggtacaacgaccgaacggtccgtccgtcccccgtcggtacctacccg

SEQ ID NO: 306152 - DNA, 539 bp, Homo sapiens
  misc_feature: GZ8MTXP02FVC3B.2.35.D02.1.454.CMB.2.raw
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactntgtctcctggtatcaacacaccccggcgaacgcccccaaactcctacatttangagtcactaagcgcccgttagggtccctgatcgcttctctggcctcagtctggcagaacgcctcctgaccgtctcgtgggcctccaagcgtgaggatgaggtctgtatttattactgcagctcaatntgacaggcagcagctaaagtgttacgtttcggacggtagggaccaagcgtacgacccgtcgtcggtaccgaacgacccgaaggtcctccgcccccgtcggtacctaccg

SEQ ID NO: 306153 - DNA, 579 bp, Homo sapiens
  misc_feature: GZ8MTXP02IJJ6E.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggctagttataactatgtctctggtatcaacaaccaccccggcgaacgacccccaaactcctcatttatgagtcactaagcggcctttagggtcctgatcgtcttctctcggctccaagtctggctagaccgggtccctccgtcgaccgttcctcgtacgggcctaccgaagccgtaggacggtagtgagtcgtagtacttaattacttcgacacgtctactatatgacgaggcagacacgaactacgtagttacgtttcggacgggtacggaaaccgtaagtcgtacgtacccgtacgtcgggtaacgacgtaccgacggtcctccggccccttcggtacccg

SEQ ID NO: 306154 - DNA, 555 bp, Homo sapiens
  misc_feature: GZ8MTXP02F23SI.2.35.D02.1.454.CMB.2.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (512)..(512): a, c, t, g, unknown or other
  misc_feature (512)..(512): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctgtntcaacaacaccccggcgaacgcccccaaatcctcatttangaggtcacgtaacgcggtacccttaggggtccctgacttcgcttctcgtggccctaccaagtctggacacggaacggccctccgtgtaccgtctcgtcgggctccgaagtcgtagagatgaggtctgtattatacgtgcagtctcagtatgctaaggcagacagactaagttgtacgtttcggaccggtagcccaaagtcgacggtaccgttcgnggtaccaacgtacccgaagtcctccgccccgtttcgctacccg

SEQ ID NO: 306155 - DNA, 532 bp, Homo sapiens
  misc_feature: GZ8MTXP02I7ZA5.2.35.D02.1.454.CMB.2.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcaccntctcctgcactggagcagcagtgacgttggcgttanaactntgtctctggtatcaacaacaccccggngaacgccccaaactcctcatttangaggtcactaagcggccttagggtccctgatcgcttctctcgcctcagtctgcagacgcctcctgaccgtcncgtcgggctccaagctcgagatagagctgattatntgcagctacatatgacacggcagacaggactaatgtacgtttcggacggtacggaactaagctaacggccgttaccgtgggtacaaccggaccgaacggtcctccggtccccctggtacccttacccg

SEQ ID NO: 306156 - DNA, 718 bp, Homo sapiens
  misc_feature: GZ8MTXP02H6OJR.2.35.D02.1.454.CMB.2.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcacatctctgcatggagcagcagtgtacgttggacgttataactntgtctctgtatacaacaccgacccggcgaaccgaccccaaactcctactatttangtacgtcaacgtaagccggtaccgttacgggtccctaggactcgtcttcgtcgtcggcctaccgaagtcgtcggcaacggaccgtcctacccgttgacccgttctccgtcgggacctaccgtaacgccgtaggacgggtagtaggacgtacgttagtaagtttaacgttacgtcgacgtagtacccttagtaacgttacgtacgacgtacggggtacaaacggacgtaacgtaactaacggtttacggtttaacccggttttccgggggaaccgggggaaccggggtaaacccgtaaacggtaccccgttacggttaaaccccggttccgggtacggttacccggaacccggtaacccggaaaccggttccccggtacccgttacccccccggttacggtttaacccctttaccccgg

SEQ ID NO: 306157 - DNA, 604 bp, Homo sapiens
  misc_feature: GZ8MTXP02JA629.2.35.D02.1.454.CMB.2.raw
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctccacactcagggcacagggtcctgggcccagtctgccctgactcagcctccctccgcgtccgggtctcctggacagtcagtcaccatctcctgaactggagcagcagtgacgttggcgttataactatgtctctgtancacacacccgcgaacnccccaactctcatttangagtcactgccggtcctacgggtcctgactcgcttctctgctcccagtcgtgcacgacgcctccgagtaccgtctcgtggcctaccgacgtcgtacgaggagtgaaaggggcctttaggcttattaaactggtcctaaggcttcgatacgtgccaaggggccaggaccaggcctaaagttcggtaacgttttttcgggacggtacgggggtaacccgaaaggccgtacggacccgtcccgtcgggggtaccgaacggtcccccgaaacgggtcccgacgtccccccgttccgggttacccacccgtttcccg

SEQ ID NO: 306158 - DNA, 607 bp, Homo sapiens
  misc_feature: GZ8MTXP02GG7M9.2.35.D02.1.454.CMB.2.raw
  modified_base (302)..(302): a, c, t, g, unknown or other
  misc_feature (302)..(302): n is a, c, g, or t
  modified_base (490)..(490): a, c, t, g, unknown or other
  misc_feature (490)..(490): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggagcagcagtgacgttggcgttataactatgtctctgtatcaaacaccaccccggacaaccgcccccaaactcctactatttangacggtacaacgtaacggccggtaccgttacggggtccctgacttccgtcttctcgtcggccctaccgaagtcgtacggacaacggaaccggtccctcccgtggtacccgttctcgtcgggcctaccgaagcgtaggagtaagtggaggtctagtatttacgttacagtacgacgtctactagttagngacgacggacagacgacgtactaagttcgttacgtttcggacggtacggactaacgcgtacgtaccgtcgtcggtacgaacgtccgaacgtccgtaccgtccccgtcgtacctcccg

SEQ ID NO: 306159 - DNA, 645 bp, Homo sapiens
  misc_feature: GZ8MTXP02GOPBR.2.35.D02.1.454.CMB.2.raw
  modified_base (303)..(303): a, c, t, g, unknown or other
  misc_feature (303)..(303): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcacgtggagcagcagtgacgttggcgttataactatgtctctgatcaacaccacccggacgaacgacccccaaactcctactatttangagtcactaagccggtccgttacgggtccctgtactccgtcttctctcggccctccgaagtctcggcacggaaccgtcctcctcgtaccgttctccgtcggcctaccgaagtccgtaggacggtaagtggaggtactggtaactttaagttacctgaccaggtcctacgtattacgcgtacgacggacgaaggccgtaaggactaacgttacggtttaccggtttacggggacgggaaacgggtaaaccgtacggtacgttaaccggtaccgttacggtacggttaccgggaagtaccgacccggtaacggtcccgtacccgtcccccggtacgttaccccg

SEQ ID NO: 306160 - DNA, 757 bp, Homo sapiens
  misc_feature: GZ8MTXP02IOV9D.2.35.D02.1.454.CMB.2.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctctgcacgtggagcagcagtgacgttggcgttatactntgtctctgtatcaacacgacccggacgaacgcccccaaatcctactatttangtagtcaacgtaacgccggtccgttacggggtccctgacttccggtcttacgtcgtcggcccctacgtaagtcctagggaccaacggaacccggtccctcccgtacggtacccgttcgttccggtcggggtaccctacgaaacgtccgttaggaaggtacggttggaacgggtctaggttaactttaacgtttacgacgtcgaacgttcctactaagttacgtcggtacgacgggacctaggacgtaacgtaacttaaggtttaccgggtttacgggttttaacgggggaccgggttaaacgggaaaccccggttaaacggtccgggtttaaacccgggtccccggtttaaaccggggttcccgggggtttaacccgtaacccggggaaccccggtaccggggtttaaccccctcccccggggtttaaccccgtccggggttacccttttaacccccgg

SEQ ID NO: 306161 - DNA, 650 bp, Homo sapiens
  misc_feature: GZ8MTXP02J17VW.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactatgtctcctgtatacaacaaccaccccggacgaaccgacccccaaactcctactatttatgacgtacaacgtaaggccggtcccgttacggggtcccctagtactccgtcctttcctcgtcggccctaccgaagtcgtcggcacgaaccgccctccgtcgaccgtctcgtggcctcgaagtctagaggtagtggagtcgtagtactttattactcgcacgtctactagtatagacgaggcacgacgaacgtactaagttacgttaaaccggtttcgggacggggtaaacgggtaacccgtaaacggtccgttacgggtaaccccgtccggttaccggggtaccgaaccggaccccgtaacggtccccgtacccggtcccccgttccgggtaccctttccccg

SEQ ID NO: 306162 - DNA, 593 bp, Homo sapiens
  misc_feature: GZ8MTXP02IR0UT.2.35.D02.1.454.CMB.2.raw
  modified_base (247)..(247): a, c, t, g, unknown or other
  misc_feature (247)..(247): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgccgtccgggtctcctggacagtcagtcacatcctctgcactggagcagcagtgacgttggcgttatactntgtctctgtatcaacacacccggcgaacgcccccaaactcctacatttatgagtcactaaggcggtacccgttaggggtcccctgactcgtcttcctctcggtcctccgagtctggcacgaaccgcctcctcgacccgtctcgtgggcctccaagctgagatgagctagtatttactacngcagtctacgattagtgacgaggcagcgaagtctaaagttcgttacgttttccggggaacgggtacggggaacctaacggtccgttacgggtacccgtccggttacgggtaccaacggaccccgtaagggtcccgtaccggtcccccgttacggtcccgttacccg

SEQ ID NO: 306163 - DNA, 649 bp, Homo sapiens
  misc_feature: GZ8MTXP02GX1YP.2.35.D02.1.454.CMB.2.raw
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (311)..(311): a, c, t, g, unknown or other
  misc_feature (311)..(311): n is a, c, g, or t
  modified_base (484)..(484): a, c, t, g, unknown or other
  misc_feature (484)..(484): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctcgccctgactcagccctccctccgcgtccgggtctcctggacagtcagtcaccatcctctgcacgtggagcagcagtgacggttggcgttaanactntgtctctgtatacaaacaaccgaccccggacaaccgacccccaaactcctatatttangacgtacaacgtaacgccggtaccgttacggggtccctagtactcgtctttctcgtcggtacccctacgtaacgttcgtacggacgaacggaaccggtccctacccgtcggtacccgttcgtcgtcggaccttacgaatcgtaggagagtagacggtctagtattagttacgngactacgtctatagtacgagacgacgacgagacgtagtacgtaagttacggttacggttacgggaacggtacggaccgtaacgtccgtacggtacccggttacggtacggtaccgaaccgtacccggtacggtcccgtacccggtaccccgtccgtacctacccg

SEQ ID NO: 306164 - DNA, 601 bp, Homo sapiens
  misc_feature: GZ8MTXP02GXJGF.2.35.D02.1.454.CMB.2.raw
  modified_base (248)..(248): a, c, t, g, unknown or other
  misc_feature (248)..(248): n is a, c, g, or t
  modified_base (452)..(452): a, c, t, g, unknown or other
  misc_feature (452)..(452): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagcagcagtgacgttggcgttatactntgtctcctgtatcaacaaccacccggcgaaccgacccccaaactcctacatttatgacggtctaacgtaacgcggtcccgttacggggtccctgactcgcttctcgtgccctcagtctggcagacgcctcctgaccgttctcgtcgggcctccgaacgctcgaggatggaggtctgtatttactactgactagcttacattagngaccgaaggccagaccgagtacgtaaagtttcggtaaccgttttcggggacggtaaccgggaccgaaacggtccgtacgtacccggtccgtacgggtaccgaacgtacccgaacggtccctccggttcccccgtacggtaccgtacccg

SEQ ID NO: 306165 - DNA, 683 bp, Homo sapiens
  misc_feature: GZ8MTXP02F4HVO.2.35.D02.1.454.CMB.2.raw
  modified_base (213)..(213): a, c, t, g, unknown or other
  misc_feature (213)..(213): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctncacgtggagcagcagtgagttggcgttaatactagtgtctcgtgtatacaacaaccgacccggacaaccgaccccctaaactcctatatttagngacgtcaacgtagccgtaccgttacggtccngtatcgtcttcacgtcggaccctaccgaagttcgtacggacgtaaacggacccggtccctacccgtacggtcccgttccgttcggtcggggtaccctaaccgtaacggtccgtaggaagttacgtcgggacgttactaggttacttaacttaacgttcgacgtactaccgttataacgttgaccgaagacggaccagttaacccgagtaaacgtaaaccgtttcggttaccgggtttaaccggggacgggtaacggaaccgtacggtccgtaacccggtaccgttccggacggttaccgaaccggacccggtagcccgtacccggtccccgtacggttactcccg

SEQ ID NO: 306166 - DNA, 635 bp, Homo sapiens
  misc_feature: GZ8MTXP02HB72C.2.35.D02.1.454.CMB.2.raw
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactatgtctctgtatcaaacaccacccggacgaaccaccccaaactcctactatttanggacgtacacgtaacgcggtaccgttagggtccctgactccgctttcgtcgtacggtccctaccgaacgtcgtacgggactaacgggtaaccgggtcccttacccgttcggtaacccgtttcgtccgtacggggtacctaccgaacgtcgtacggagagtaggaacggtctagtatttactacgtagcagtctacattatcgacgacggacgacgacgagacttaagttcggtttacgttacgggacgggacggtacacggacgtacggtacccgtcggtacggtaccgaacggaccgtaacggccgtacccgccccgtacggtaccttacccg

SEQ ID NO: 306167 - DNA, 592 bp, Homo sapiens
  misc_feature: GZ8MTXP02INEB2.2.35.D02.1.454.CMB.2.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctcgcgtcggtctcctggacagtcagtcacatctcctgcacgtggagcagcagtgacgttggcgttatactntgtctctgtatcaacacacccggacaacgacccccaaactcctacatttangacgtcaacgtaacgcggtcccgttacggggtccctgtactccgtcttctcgtggccctccgagtctaggcacggaccgtcctccgtcgaccgttctcgtgggcctccgaagcgtggagcgtggagtctgttaattacttacgtcgcacgtctacgtagtacgtgacgaaggcgagacgagtactaaagttcggttaacgtttcgggaacgggacggtaccaaacggtccgtacggtacccgtcgtaccggtacaaccggtcccgaagtcccgtaccgcccccgttaggaccttcccg

SEQ ID NO: 306168 - DNA, 750 bp, Homo sapiens
  misc_feature: GZ8MTXP02F7TRK.2.35.D02.1.454.CMB.2.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggagcagcagtgacgttggcgttatactntgtctctgtatacaacaccacccggacgaacgacccccaaactcctactatttangtacgtcaaccgtaaggccggtacccgttacggggtccctagtacgttcgtcctttcgtccgttcggaccccttaccgtaaacgttcgtacggtaccgaaccggtaaaccgggtcccccgttcccccgtacggtacccccggtttaccgttcccggttcggggtaccctttacccgaaaggcccgttaggaacggggtacgtagggaacgggtctacggttaaacttttacgttaccgtacggacaacggttcctacctagttaaacgttcgacggaacggaccacggaccgtagtaaaccgtaaggtttaccgtttaaccgggtttacgggacggggttaaacgggaccgtaaacggtccgtacggttacccgggtccgtacgggtaccgaaccggtcccgtaaacggtcccgtacccggtcccccgtcggtacccttaccccgg

SEQ ID NO: 306169 - DNA, 632 bp, Homo sapiens
  misc_feature: GZ8MTXP02FTF30.2.35.D02.1.454.CMB.2.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggacgttataactatgtctcgtgtactacgaacaaccaccccggacgaaccgacccccaaactcctatatttangaggtacacgtaagccgtccgtagggtccctgatcgcttntcgtgcctcagtcnggcacgacgtcctaccgtcgtacctctcgnggtcacagctgganagtggagtctaggtattacgttnacgacgngtactacgtaattacgtcgacgtaggacacgggacacggtaactaacgtttaggtttaccggtttaaccggggaacgggaaaacggtaaaccgtaacggttcccggttacgggttaaccccgttcgggtaccgggtaaccgaaccggaaccccgtaacggtccgtacccccgtcccggtaacgtcccttacccg

SEQ ID NO: 306170 - DNA, 640 bp, Homo sapiens
  misc_feature: GZ8MTXP02G7ULO.2.35.D02.1.454.CMB.2.raw
  modified_base (246)..(246): a, c, t, g, unknown or other
  misc_feature (246)..(246): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcacgtggagcagcagtgacgttgcgttatactntgtctctgtatcaacacacccggcaacgacccccaaactcctacatttatgagtcacgtacgcggtccgttagggtccctgactcgtcttctctgccctcagtctgcagacgcctcctcgaccgtctcgtcgggcctaccgaacgtcgtaggacggtgtacggaggtcttaggtaactttaacgttacgtacgtcgtaaacgtccttactagttacgtcgacgacggaccgtagactacgacgttaaagttcggtttaacgtttcggggacggaacgggtaacctacggtaccggttaccggtaacccgggttcgtacgggggttaccaacccgggtaccccggtaacgggtcccgttacccccggtacccccgttccgggtaaccttccccgg

SEQ ID NO: 306171 - DNA, 615 bp, Homo sapiens
  misc_feature: GZ8MTXP02H76R5.2.35.D02.1.454.CMB.2.raw
  modified_base (194)..(194): a, c, t, g, unknown or other
  misc_feature (194)..(194): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
  modified_base (427)..(427): a, c, t, g, unknown or other
  misc_feature (427)..(427): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggccagtctgccctgactcagcctcctccgcgtccgggtctcctggacngtcagtcaccatctcctgcacgtggagcagcagtgacgttggcgttanactatgtctcgtgtatcaacaaccaccccggnaaaccgcccccaaactcctactatttactcggagtcaacgtaagccggtaccgtttaggggtccctgtactcgctttcncgtcggcctccgaagtctggcacggaacggtcctccgtagtacccgtcgtacgtcggctaccaagtcagacganggagtctacgtattagtactgcagtctacattagcgacgaggacaacgacgaacggactaacgttacgttacggttttaccgggacgggacggggaaacccgtaaggtaccgtcggtaccgtcccgttgggtaccgaaccggcccggtaacgtcccgtaccgtcccccgttacggtacccttaccccg

SEQ ID NO: 306172 - DNA, 664 bp, Homo sapiens
  misc_feature: GZ8MTXP02F62T4.2.35.D02.1.454.CMB.2.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgacgttggcgttanaactntgtctctgtatcaacaccgacccggacgaaccgacccccaaactcctactatttangacggtcaacgtaacgccggtaccccgttagggtccctgactcgtcttctcgtcggtcccctaccgagtctaggacacggaaccgccctcccgtacgacccgttctcgcgggtacctaccgaaacgtcgtaggaggtacgtagggacgtacgtaggttaaactttacgttacgtacgaccgtacgtaccttacgaagttacgtacggaaccgacgggaccacgacgtaacgtactaaggtttacggtttaacgtttcggggaacgggtaacggaactaacggtcgtacggtaccgtacgaacggttcgggaacaccggacccggtaacgtcccgtacccggtaccccgtacgttccccg

SEQ ID NO: 306173 - DNA, 562 bp, Homo sapiens
  misc_feature: GZ8MTXP02FK3OC.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtatcaacacaccccggnaacgccccaaactcctcatttangacgtcactaagccggtccttagggtccctgactcgcttctctggcctcagtctggcacgaacgcctcctgaccgtctcgtgggctccgaagcgtgacgatcggagtctagtattacttacgtgcagtctacatagtgacgaggacaggcaagtacaagttcgttaccgttcgggacggtacgggaccaaacggtcctacggacccgttcgtacggggtaccaacggtacccgaacggccgtacccgtccccgtcggtacctacccg

SEQ ID NO: 306174 - DNA, 535 bp, Homo sapiens
  misc_feature: GZ8MTXP02JYFTM.2.35.D02.1.454.CMB.2.raw
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (491)..(491): a, c, t, g, unknown or other
  misc_feature (491)..(491): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgccgtccgggtctcctggacagtcagtcaccatctcctgcactggaggcagcagtgacgttggcgttaatactatgtctctgtatcaacaacaccccggcaacgcccccaaactcctacatttangagtcactaagcgccgttagggccctgactcgcttctctggcctccaagtcngcacgacgtcctccngccgtnctggctccagctgagtnggagctgatttanacgtgcagtctacgatagtgcgaggcagtcaagtcaagttcgttacgttcgggacggtacggaaccagtccgtacgaccgttccgnggtaccgaagtaccccgaggtccttccgccccgtgtccctaccg

SEQ ID NO: 306175 - DNA, 524 bp, Homo sapiens
  misc_feature: GZ8MTXP02IOP0E.2.35.D02.1.454.CMB.2.raw
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgcccctgactcagcctccctcgcgtccggtctcctggacagtcagtcaccatcctcctgcactggagcagcagtgacgttggcgttatactntgtctctgtatcaacaaccgacccggcgaacncccccaaactcctactatttangtagtcaacgtaacgccggtacccgttacggggtccctgtactcgtcttctcgtgccctcagtctggcacgaccgcctccgngaccttcncgtggctcagctgacgntggagctagtattatacngcacgtctataatgtgcgagcagcanactatcgttacgtcggcggagaccagcgacgcgtcgnggacaacgccgtagccctccgcccctggtactccg

SEQ ID NO: 306176 - DNA, 586 bp, Homo sapiens
  misc_feature: GZ8MTXP02FMKDH.2.35.D02.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggagcagcagtgacgttggcgttataactntgtctctgtatcaacacaccccggcaacgcccccaaatcctacatttangagtcacgtaagcgtccgttagggccctgactcgtcttctcgtggccctaccaagtctggactacggaaccgtccctccgtagtaccgtctcgtcgggcctacaagtctaggacgtatggacgtctagtattacttacgngcaagctacaagttancgacgacggaccaggacaagtacctaaagttcgtttaacgttcgggacggtaacggacctaacggccgtacggtaccgttcgtggtaccaacggtacccgaacggtccctccgtccccgtacggtactaaccccg

SEQ ID NO: 306177 - DNA, 678 bp, Homo sapiens
  misc_feature: GZ8MTXP02I8QKW.2.35.D02.1.454.CMB.2.raw
  modified_base (195)..(195): a, c, t, g, unknown or other
  misc_feature (195)..(195): n is a, c, g, or t
  modified_base (308)..(308): a, c, t, g, unknown or other
  misc_feature (308)..(308): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctcctgcacgtggagcagcagtgacgttggacgttaatactatgtctcgtgtactcaacaaccaccccggacaaccgaccccctaaactcctactatttanggtacgtacacgtaacgccggtacccgttacgggtccctagtactccgtcttcctcgtcgcccctacgtacgtgtcggacgtaacggacccgtccctccgtcgacccgttctccgtcgggcctaccgaagtcgtaggagtcggaggacgtgcttaagtttaccgtgctagtctacagttatgacgacggacacgtacgacgtagtaacgttacggtttacgttttaccgggacgggtaaccggggaaacgtaaccggggtacctaccggtacccggttaccccgtcggggttacccgaacggaacccccggtaacgggaccccgtaccggtacccccccggttacccggttcccggtaaccctttccccg

SEQ ID NO: 306178 - DNA, 587 bp, Homo sapiens
  misc_feature: GZ8MTXP02GL52U.2.35.D02.1.454.CMB.2.raw
  modified_base (302)..(302): a, c, t, g, unknown or other
  misc_feature (302)..(302): n is a, c, g, or t
  modified_base (448)..(448): a, c, t, g, unknown or other
  misc_feature (448)..(448): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagcagcagtgacgttggcggttataactatgtctcctggtatcaacaaccaccccggcgaacgcccccaaactcctcatttangaggtcactaagcggccttaggggcccctgatcgcttctctggccctccaagtctggcaggaacgccctccctgacccgtctccgtgggcctaccaagcgtgacggatggagctgaattagttactagcagtcctacgtattaagngtcgagcagacagacagttagttacgttttcgggacgggtacgggaccaaacggtccgtacgtacccgtccgttacggggttacccgaacggtaccccgaaaggtcccgtaccggcccccgttcggtacccgttacccg

SEQ ID NO: 306179 - DNA, 594 bp, Homo sapiens
  misc_feature: GZ8MTXP02IIQDE.2.35.D02.1.454.CMB.2.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (426)..(426): a, c, t, g, unknown or other
  misc_feature (426)..(426): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtcaccatcctcctgcactggagcagcagtgacgttggcgttataactntgtctctgtancaacacnccgnaacnccccaancctnatttangagtcaactagcgtacccgttagggtccctgtactcgtcttctcgtggccctaccagtctggacacggaacccggtcctcccgagtcccgttctcgtcgggtcctaccgaaagtccgtggaggtagttaacgggngtactagtacttacgttacgcgtactacgtctaacgtagtagcgtacgacgacgagacgtacgtacttagttacggttacggttacgggacggtacggacgacgtacgtacgtaccgtacggtcgaccgcgaccgtacggtccgtacccgtcccgtacgtaccgtccg

SEQ ID NO: 306180 - DNA, 672 bp, Homo sapiens
  misc_feature: GZ8MTXP02GYFRF.2.35.D02.1.454.CMB.2.raw
  modified_base (310)..(310): a, c, t, g, unknown or other
  misc_feature (310)..(310): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcacgtggagcagcagtgacggttggcgttaatactatgtctcgtgtactcaacaccgaccccggacgaaccgacccccaaactccctactatttacnggtaacggtacacgttaacgccggtacccgttaggggtcccctggactccgtcttcctcgtcggtaccctaccgaagtctacgggaccgtaacggaacccgggtccctacccgtacggtacccgttcgttcggtcgggtcctaccgaacgtccgtagaaggtacgaggtaaggccttaggtaatttacttacttcggaccttaagcctaacgtacttaagcgacgacggacacgactaaagcgttaagtcggtttaaaccgttcgggaacgggttacggaaccgtaacggtctaacccgggtccggtccttacggggaccaaccgtaccggacgtcctcccgtaccccgtcgtacttccccg

SEQ ID NO: 306181 - DNA, 640 bp, Homo sapiens
  misc_feature: GZ8MTXP02IB5YX.2.35.D02.1.454.CMB.2.raw
  modified_base (254)..(254): a, c, t, g, unknown or other
  misc_feature (254)..(254): n is a, c, g, or t
  modified_base (311)..(311): a, c, t, g, unknown or other
  misc_feature (311)..(311): n is a, c, g, or t
  modified_base (437)..(437): a, c, t, g, unknown or other
  misc_feature (437)..(437): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggagcagcagtgtacggttggacgttaataactntgtctcctggtatcaaacacaccccggcgaaccgacccccaaactcctactatttangtagtacaacgtacggcggtacccgttacgggtcccgtgtactccgtcttctcgtgccctaccgagtcgtgcgacgaaccgtccgtccgtcggtaccgttccgtccgtggggtacctaccgtacgngcggaggtagtggaggtctaggttaatttaacgttacgtacgccgtaacgtacccgtatacgttagacgacgggaaccacggtacaacgtacgtacttaaggtttccgtttacgggtccggtaacggggaacgacgtaccgacggttcgtaccggtcggtacgacgtaaccgacggtaccgcgtcccgcccgtacgtctcccg

SEQ ID NO: 306182 - DNA, 637 bp, Homo sapiens
  misc_feature: GZ8MTXP02G72V9.2.35.D02.1.454.CMB.2.raw
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (470)..(470): a, c, t, g, unknown or other
  misc_feature (470)..(470): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggagcagcagtgacgttggcgttataactntgtctctgtatcaacaaccaccccggacgaacgacccccaaactcctactagtttanggtacgtacaacgtaacggcggtaccccgttaggggtcccctgactcgtccttctctggccctacaagttcaggtcacggaacgccctccctacgtacccgttctcgtacgggcctaccgaagtctaggagngtgaggtntcgtaatttatacgtgcgagtccttanatagcgacgagacacgacgagtacgttaacgttacggtttacggttacggggaaccgggtaacgggaccgtaacggtaccgttccggtacccggtaccggtaccgggtaccgaaccggtacccggacggtaccccgtcccggtacccccgttacggtaccctacccg

SEQ ID NO: 306183 - DNA, 595 bp, Homo sapiens
  misc_feature: GZ8MTXP02FN2V2.2.35.D02.1.454.CMB.2.raw
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (420)..(420): a, c, t, g, unknown or other
  misc_feature (420)..(420): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttanaactatgtctctggtatcaacacaccccggnaacgcccccaaactcctcatttangagtcactaacgcggccttagggtccctgactcgcttctctcggcctccagtctgcagacggcctcctgacctctcgtgggctccgaagtctagaggatggacggctgtaatttattacgngcaagctactatatcggacgaaggccaaggcacggtactaaacgttgtttaaccgttttcggggacgggtacggggtaaccctaacggtccgttacggtacccggttccgttcgggggtaccaacggaccccgtaacggtcccgtaccggtccccccgtcggtaccctaaccccg

SEQ ID NO: 306184 - DNA, 722 bp, Homo sapiens
  misc_feature: GZ8MTXP02FROG4.2.35.D02.1.454.CMB.2.raw
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
  modified_base (424)..(424): a, c, t, g, unknown or other
  misc_feature (424)..(424): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatctcctgcacgtggagcagcagtgacgttggcgttatactntgtctcgtgatcaaacaccgtacccggacaacgacccccaaactcctactaatttagngtacggtacctaagtaacgccggtacccgttacggggtccctggtaccttcgtcctttctcgtcggcccctaccgaacgtcgttacggactaacggaacccgggtccccttccgngtacccgtcctcgtaggggcctaccgaaagtcgtaggaagggtagtaggacgttacgtagtttaagtttaacgtacgtacgacgtacgtcctacgtagtacgtcggaggtacgacgacgtaacgtagtaacgttacgtttaccgggtttacgggtttaccgggaacggggtaaccgggtaaccgttaaaccggtccggtaccggttaccccgggttacggtccgggtaacccgtaaccggaccccggtaaccggtccccgttacccccggtacccccggttccggttacccgttcccg

SEQ ID NO: 306185 - DNA, 628 bp, Homo sapiens
  misc_feature: GZ8MTXP02IVL48.2.35.D02.1.454.CMB.2.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctcgccgtccgggtctccgtggacagtcagtcaccatctccngcacgtggagcagcaggtgacgttggacgttataactntgtctcgtgactacaacaccgacccgganaaccgacccccaaactcctactaatttacngtacgtcaacgtaacggccggtaccgttacggggtccctgactcgtcttcncgtcgccctacgagtcgtgacacggtaccgcctccgtcgtcctcgtcgtcggcctacagtctaaganagtgagtactagttaacttacgtacngacatacttagaagttgtacgcgaacgactaaggacctaagtaaccgttaaaggtttcggttaaccgttacggggacggtaaacgggactacgtaccgtacgggtacccgtacggttacgacgaaccggacccgtaacggtcccgtccgtaccccgttcggtaccttacccg

SEQ ID NO: 306186 - DNA, 869 bp, Homo sapiens
  misc_feature: GZ8MTXP02JS1XX.2.35.D02.1.454.CMB.2.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcactggagcagcagtgacgttggcgttatactntgtctctggtactcaacaacaccccggcgaaccgacccccaaactcctactaatttacnggtacgtcaacgtaaggccggtacccgttacggggtccctaggtacttccgtctttccgtacgtcggacccttaccgtaagttcctacgggacgaaccggaaccgggtcccttcccgtacggtaccccgttccgttccggtcggggtacccttacccggaaacgtccgtaaggtacgggtagtacggggtaacgggtacttacggtaattttacgttaaccgtcggtaccgtaaacggttcccttaaaccgttaattaccgggtacgggtaccgggtaaaccgggtaccgtaaaccgggtaccgtaaacggtaaaccggttaaacggtttttacccgggttttaaacccgggggtttacccgggggtaaaccgggggtaaaacccggggtaaaccccggttaaacggttcccgggttaaacccgggttaaccccgggtttaccggggttaccccgggggttaaacccgaaccccgggtaaaccccggggtaacccgggttacccccggttaccccccgggttaaccccccggttaccgggttacccccgtttaaccccggg

SEQ ID NO: 306187 - DNA, 683 bp, Homo sapiens
  misc_feature: GZ8MTXP02HSYAC.2.35.D02.1.454.CMB.2.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgcctgactcagcctcctcgcgtccggtctcctggacagtcagtcaccatctcctgcacgtggagcagcagtgacgttggcgttanaactntgtctcctgtatacaacaaccaccccggacgaacgcccccaaactcctactatttactggtacggtcaaccgttaaggccggtaccccgtttaacggggtcccctaggtactcggtccttccgtcgcggtcccctacctaagtcgtacggcaacggaaccgggtccccttccgtacgtaccccgtcttccgacggggtacccttacccgaaagttccgtacggtaaagggtacgtacgggacgttacgttaaggttaactttaaacgttaaccgtcgtaaccgtacggttacctacgtaacgttaacgtacggtacgacgacgacgacgacgtacgtaacgttacgttacggttacggtacgggtacggacgacgtacgtacgtaccgtacgtacgacgaaccgaccgacgtccgtcccgtcccgtccgtaccgtccg

SEQ ID NO: 306188 - DNA, 639 bp, Homo sapiens
  misc_feature: GZ8MTXP02GLF75.2.35.D02.1.454.CMB.2.raw
  modified_base (250)..(250): a, c, t, g, unknown or other
  misc_feature (250)..(250): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatctcctgcacgtggagcagcagtgacggttggcgttataactntgtctcgtgtatcaacaaccacccggacgaaccgacccccaaactcctactatttacgngtacgtacaactaagccggtccgttacggggtccctgactcgtcttcncgtcgccctacagtcgtacgcacgaccgcctccgtcgtaccgtctcgtcggctacgagtcnggagctaggngtctagtattagtacgtcgcgtagtcctagtacgttagcgacggacggacaacgacgacgtaacttaaagttccggtttaaccgtttacggggaacgggtaacgggtaaccgaaccggttacgtacggttacccgtccggttaccggggtaccaaccggaccccgttaacgggcccttaccccgggtccccttccggtaccctttccccgg

SEQ ID NO: 306189 - DNA, 677 bp, Homo sapiens
  misc_feature: GZ8MTXP02G0M4Z.2.35.D02.1.454.CMB.2.raw
  modified_base (250)..(250): a, c, t, g, unknown or other
  misc_feature (250)..(250): n is a, c, g, or t
tcagacgctcgacacacgaccggtgctcgatttagcacacgatagttgggtttgggggtctcaggaggcaacgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcgttaataactntcgtctcgtgtactacaacaccacccggacgaaccgcccccaaactcctactatttatgacgtacacgtaacggccggtccgttacggggtccctgactcgtcttcgtcgtcggtactacccgtaagttccgtacggacaacggtaacccgtccccttacccgtcggtacccgttccgttccgtacggggtaccttaccgaacggtcgtagacggtagtcggaggtcttagtatttacgtactgtacacgtctacgtaatcgtgacgacgggtacaggtaacacggtaacttaacgttcggttaacggtttcggggaacgggtaacggaaccgtaaggtccgtaccgggtaacccgttcgggtacggtaccgaaccggaaccggtaacggtcccgtacccgtccccggtagtacccgtcctttcccg

SEQ ID NO: 306190 - DNA, 628 bp, Homo sapiens
  misc_feature: GZ8MTXP02I8A29.2.35.D02.1.454.CMB.2.raw
  modified_base (248)..(248): a, c, t, g, unknown or other
  misc_feature (248)..(248): n is a, c, g, or t
  modified_base (310)..(310): a, c, t, g, unknown or other
  misc_feature (310)..(310): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggagcagcagtgacgttggcgttataactntgtctcctggtactcaaacaccgaccccggagaaaccgccccctaaactcctactaatttanggtaacgtacaacgtaaggccggtaccgtttacggggtccctaggactccgtctttcgtcgtggtcccctaccgagtcgtacggacaacggacccgtcccttcccgtagacccgttcgtcgtcgggacctaccgaaacgtctaggaacgtagtacggacggtctaggtaactttacgtactgctaagtctacaaatcgtgacgaaggcagaccaggtactaacgttcgttacgttcgggacggtacggacctacgcgtacggccgtacgtcggacaacggaccgacggcccgtaccgtccccgtacggactttacccg

SEQ ID NO: 306191 - DNA, 608 bp, Homo sapiens
  misc_feature: GZ8MTXP02G4CLZ.2.35.D02.1.454.CMB.2.raw
  modified_base (301)..(301): a, c, t, g, unknown or other
  misc_feature (301)..(301): n is a, c, g, or t
  modified_base (380)..(380): a, c, t, g, unknown or other
  misc_feature (380)..(380): n is a, c, g, or t
  modified_base (439)..(439): a, c, t, g, unknown or other
  misc_feature (439)..(439): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtccaccatctcctgcactggagcagcagtgacgttggcgttaatactatgtctctgtatcaacacacccggacgaacgacccccaaactcctactatttangacgtacactaagccggtaccgttagggtccctgtactcgtacttctcgtggccctcagtctggcagaaccgcctccgngtaccctctcgtcggctaccgaagcgtaggaggtatacggagcttagtattagttacgngtctagtctactatagtcgacgagggccaagtcaagtaccgtaagtttaccgttaccggtttacgggacgggtaaccggaaccggtaacgtccgtaccggtacccgtcggtacggtaccgaacggtacccgaacggtcctacccggtcccccgttcgaccttaccccgg

SEQ ID NO: 306192 - DNA, 659 bp, Homo sapiens
  misc_feature: GZ8MTXP02GFYFO.2.35.D02.1.454.CMB.2.raw
  modified_base (311)..(311): a, c, t, g, unknown or other
  misc_feature (311)..(311): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcacgcctccctccgcgttccgggtctcctggacagtcagtccacatctcctgcactggacgcagcagtgacgttggcgatataactatcgtctctggtacacaacaaccaccccggacgaaccacccccgaactcctactatttancggtagtacaacgtaacgccggtcccgttaacggggtccctagacttccgcttcgtcgtcgtcctacgaacgtctggccaacgaccggtcctaccgtcgacccgtcttcgtgggcctacgtaaggctagaaggtactggaacggtctagttaactttattacgtgacacgtctagtactagtgacgacgaccgagaccgtaagcgttaaaacgtcgtttaacggttacccgggaggggtaaacccggtaacgaaacggttccgtacggtaaccggttcccggttaacggtaacgtaccggaaacccggtacggttcccgtcccggtaacccccgttcggttaaccccg

SEQ ID NO: 306193 - DNA, 686 bp, Homo sapiens
  misc_feature: GZ8MTXP02IMH3Q.2.35.D02.1.454.CMB.2.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggagcagcagtgacgttggcgttataactntgtctctgtatcaacacncccggacaacgccccaaatcctactatttangagtcaactaagcggtccgttacgggtccctgactcgtcttctctcgccctccgaacgtctggcaacggaaccggcccttcccgtcggacccgttcctaccgtcggggccttacccgaaagctacggagacgtggagggtcttaggtaatttacttaacgtcgaccgtacggtccttacgaagttacgtacggtacggaaaccgggctacggaccgaaggtaccttaaacggtttacggtttaaccgggtttttccgggggaaaccgggggttaacgggaaacccgaaacgggtccgtaaaccgggtccccggttacggttaccgggtaccgaaccggtaccccgaacgggttcccgtcccggtacccccgttcggggtacctttaacccg

SEQ ID NO: 306194 - DNA, 638 bp, Homo sapiens
  misc_feature: GZ8MTXP02GHQLT.2.35.D02.1.454.CMB.2.raw
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctctgcactggagcagcagtgacgttggngttanactntgtctctgtatcaacaacaccccgacgaacgaccccaaactccactatttangaggtacactaacgccggtcccgttaggggtccctgactcgtcttctcgtgccctacaagtctggactaacggaaccgtccctcccgtacggacccgttcgtccgtcgggccttacaaacggcctaggaggattggagtctagtactttaagttacctgactagccttagattacgtcgacgagaccaggcaagtactaagttcgtttaacgttccgggacgggtaacgggggtaaccaaacgggtcgtaccgtaacccgggtaccgttccggggtaccgaacccgggtcccgaaaacgggtcccgtcccgggtacccccgtaccgggtccttaaccccgg

SEQ ID NO: 306195 - DNA, 691 bp, Homo sapiens
  misc_feature: GZ8MTXP02FQZYN.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagccctccctccgcgtccgggtctccgtggacagtcagtcaccatctcctgcacgtggacgcagcagtgacgttggcgttatactatgtctctggtactacaacaaccgacccggacgaaccgacccccaaactcctatactttatggacgtacacgtaacgccggtaccgttcgggtaccctgtactcgtcttctcgtcgtccctaccgaagtcgtacggtacgacgaacccggtcctcccgtacggtacccgttcgtacgtcggtcctaccgaagtcgtacggagtagtaggtacgtactagtaatttacttacgtcgacgtacgtactacgtagttcgtcggaacggcgaaccgtagaccgtaacgtaaccgtaaggtttaccggtttacggtttaccggggaacggggtaccgggtaaaccacgggtaccgttaccgggtaccccgttacggttaccgggccgaaaccggtcccgaacgggtccccgtccccggtacccccgttcggtacccgtttacccg

SEQ ID NO: 306196 - DNA, 629 bp, Homo sapiens
  misc_feature: GZ8MTXP02H7CTN.2.35.D02.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (445)..(445): a, c, t, g, unknown or other
  misc_feature (445)..(445): n is a, c, g, or t
  modified_base (481)..(481): a, c, t, g, unknown or other
  misc_feature (481)..(481): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgcctgactcagcctccctcgcgtccgggtctcctggacagtcagtccacntctccngcatggagcagcagtgacgttggacgttaaactntgtctcgtganacaacaccaccggacaacgccccaaactcctactattatgacgtacaacgtaagcggtccgttaagggtcccaggtactcgtccttcgtccgtggtaccctacccgtaaagttccgacggtaacaaccggtaaccggtccccctttacgacgtcccgtctcggtcggcctacaacgtcgagtaagcgnggacgtgttagtacttagtaacctgacaagtcctanagttaagagacgagacgacgacgacgtacgtacgttacgttacgttacgggtacggtacggaacgtaacgtacgtaccgtaccgtaccggtacggtaccgtaaccgtaccgaccggtaccgtacccgtacccgtccgtaccgtacccg

SEQ ID NO: 306197 - DNA, 598 bp, Homo sapiens
  misc_feature: GZ8MTXP02FROVX.2.35.D02.1.454.CMB.2.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcatggagcagcagtgacgttggcgttataactntgtctctgtatcaacacacccggacaacgacccccaaactcctacactttangtacggtacaacgtaaggccggtcccgttacggggtcccctgacttccgtcttctcgtcgccctaccagtctggacacggaaccggtccctcctcgtaccgtctcgtcgggcctaccaagcgtgagtactggaggtctagtaatttattacgtacgaccgtagtcctactaatacgtacgacgaggtaccagccgagtactaagttcggtttacgtttcggggacggtacggaccacgtcgtacgaccgtcgtcggacgaaccgaccgtacggccctccgtccccgtacgtacgtcccg

SEQ ID NO: 306198 - DNA, 547 bp, Homo sapiens
  misc_feature: GZ8MTXP02FO62S.2.35.D02.1.454.CMB.2.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcacgtggaggcagcagtgacgttggacgttaataactatgtctctgtatcaaacaaccgaccccggnaacgacccccaaatcctatatttangagtcaactaagccggtccttaggggtccctagactcgcttctctggcccctacagtctggacagaccgtcctccagaccgtctgtcggctaccagtctgagatggagctgtacttatcgngacagtctagattagngacgagacagactagataagtcgttacgttcggacggaggactaaggccgtacgtccgtcgtcggacaacgtaccaaggccgtccgtcccgtcgtcttaccg

SEQ ID NO: 306199 - DNA, 553 bp, Homo sapiens
  misc_feature: GZ8MTXP02JCJBT.2.35.D02.1.454.CMB.2.raw
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggcgttatactntgtctctgtatcaaacaccacccggacgaacaccccaaactcctactaatttangaggtcaacgtaacggccgtcccgttagggtccctgactccgtcttctctcggtcctccgagtctcgacacgacgcctccncgtaccgtctcgcgctcgagcngagntggagctagtattatacgtgctagtctacatacgtgacgagacgacgcgagtactaaacgttgttacgtttcggacgggtacggacgacgtcgtacggaccgtcgtacgcgtaacgaccggacgcctccgcccgttcggctacccg

SEQ ID NO: 306200 - DNA, 581 bp, Homo sapiens
  misc_feature: GZ8MTXP02GV9LE.2.35.D02.1.454.CMB.2.raw
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (417)..(417): a, c, t, g, unknown or other
  misc_feature (417)..(417): n is a, c, g, or t
  modified_base (544)..(544): a, c, t, g, unknown or other
  misc_feature (544)..(544): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggagcagcagtgagttggcgttanaactntgtctctgtatcaacaacacccggcaacgcccccaaatcctactatttancgtacggtcaacgtaacgccggtccgttaggggtccctggactcgcttctcgtgccctcgaagtctggcaagaccgtcccgtacctggacctctcgtggacctacgaagtctaggaagngtcggagtctagtaatttacgttaccgtgcgagtctacgtaatcgtagacgaacggcaacggcaggactaagttcgtacgtttcgggacggacggtacaacgtcgtacggtaccgtccgtgggtacncggacccacggtcctaccgccccgtcggtccttaccg

SEQ ID NO: 306201 - DNA, 665 bp, Homo sapiens
  misc_feature: GZ8MTXP02FF862.2.35.D02.1.454.CMB.2.raw
  modified_base (251)..(251): a, c, t, g, unknown or other
  misc_feature (251)..(251): n is a, c, g, or t
  modified_base (313)..(313): a, c, t, g, unknown or other
  misc_feature (313)..(313): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggagcagcagtgacgttggcggttaataactntgtctctggtactacaaacaaccgaccccggacgaaccgacccccaaactcctactatttangacgtcacgtaacggccggtacccgttacggggtccctgacttcgtcttctcgtgcccctacctagtctcggacacggaccgtccctcccgtcgaccgttccgtcgtcgggtccctacgaacgctaggacggtatggacgtctagttatttaacttacgtcgactagtctacgtactagttacggaccgaaggccgacgacgaacgtacgtaagttaccggttttaacggtttcggggaacggggtaaccgggacgtaacgtacggttaccgtaacccggtccggtacgggtaccgaaccggtaacccggtacggtcccgtaccccggtccccgtccggtaccttaccccgg

SEQ ID NO: 306202 - DNA, 665 bp, Homo sapiens
  misc_feature: GZ8MTXP02F7SGU.2.35.D02.1.454.CMB.2.raw
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttatactatgtctctgtatcaacacacccgacgaacgaccccaaactcctactatttactgaacgtccaactaacggcggtacccgttacggggtcccctgactcgtcttctcgtaggccctaccaagtctacggcaacggtaaccgggccctcccgtcgtaacccggttcctcgttcgggcttacccgaaagtctaggagaatggacgggtactaggtaactttaactttaccgtagacctagtcctactaagtagtagacgtaggaccgagtacgacgtaaacgtacgttacgtttaccggtttacggggacgggtaaacggtaacgtaaccggttacgtaccgggtaacccgtacgtaacggttccggtaaccgtacccggaaccggtaccggtcccgtacccggtcccccgttacggtaccg

SEQ ID NO: 306203 - DNA, 707 bp, Homo sapiens
  misc_feature: GZ8MTXP02FKFBD.2.35.D02.1.454.CMB.2.raw
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (509)..(509): a, c, t, g, unknown or other
  misc_feature (509)..(509): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcacgtggagcagcagtgacgttggcgtttanactatgtctctgtatcaacaccgacccgganaaccgccccaaactcctatactttanggtacgtaccaacgtaacggccggttcccggttaacgggtccctagacttcgtcctttcgtccgtagccccgttacccgaagttccgacgggacaacggtaaccggtcccctccgtacggtacccgttccgtcgtacggggtacccttaccgaaacgtcgtaaggacgggtagttggaacgggtactaggttaactttacttaaccgngtacgtacgtctaactagtaactcggaacgagggacacggtaccgtaagtaacgttaaacgtttcggtttaaccgggtttacggggaacgggtaaccgggtaaccaacggttaccgtaccggtaacccggtttccggacggggtaccaaccggacccggaacggtccccgtcccgtaccccggtccggtacttccccg

SEQ ID NO: 306204 - DNA, 641 bp, Homo sapiens
  misc_feature: GZ8MTXP02FHDXR.2.35.D02.1.454.CMB.2.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (303)..(303): a, c, t, g, unknown or other
  misc_feature (303)..(303): n is a, c, g, or t
  modified_base (390)..(390): a, c, t, g, unknown or other
  misc_feature (390)..(390): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttataactntgtctcctgtntcaacaaccaccccggacgaacgcccccaaactcctatatttangacggtacactaacggccggtcccgttacggggtccctgacgtcgtcttctctggccctacagtctcggcaagaacggtcctcccgngtaccgtctcgtcgggacctccgaacgcgtaggacggtagtggaacgtctacggtaatttaacttacttcggactacgtctacgtattacgacgacgaaggtaccgaagaccgaagactaaagttacggtttaaccggtttcgggaacgggtaacggggaaacctaaacggcgttaccggtacccggttccggtcgggttaacgaaccggacccggaacggtcccgtccgtcccccgtacggtcctacccg

SEQ ID NO: 306205 - DNA, 632 bp, Homo sapiens
  misc_feature: GZ8MTXP02GTDI1.2.35.D02.1.454.CMB.2.raw
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (464)..(464): a, c, t, g, unknown or other
  misc_feature (464)..(464): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatcctctgcacgtggagcagcagtgacgttggcgttataactntgtctctgtatcaacacncccggacaaccgaccccaaactcctactattangagtcactacgcggtccgttacggggtccctggactccgtcttctcgtcggccctaccgtaagtccgtggacacggaaccggccctcccgtcggacccgttcctcgtacgggtcctcccgaaacgtcgtaggaggtataggaggtcgtagtatttaacttacngtacacgtccttatagttacgtacgcgtagacgaggaccaaggtacttaaggttacgtttaccgggtttacggggaacgggaacggggtaccaaacggtcgtaacggtccggtacgtcgggtacaacgtacccgacggtccgtacccgtccccgtacggtacctcccg

SEQ ID NO: 306206 - DNA, 614 bp, Homo sapiens
  misc_feature: GZ8MTXP02IGJXY.2.35.D02.1.454.CMB.2.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagccctcctcgcgtccggtctcctggacagtcagtcacatctcctgcactggagcagcagtgtacgttggacgttataactntgtctctgtatcaacacacccggcgaacgacccccaactcctactatttacngtacggtcaacgtaacggccggtacccgttacggggtccctgtacgtccgtcttctcgtcgccctacgacgtctgacgacgaaccgtcctaccgtcgtaccgtctcgtcggtctacacgtctaggagtacgtggagtctagtatttacgtagtgcagtctactatagtcgacgagacgacgacgtagaccgttaaagtttccgtttaacggtttccgggaacgggtacgggaccaaacggtccgtaacggtcccggtcggtcggttaccgaaccggccgtaacggtccgtcccgtccccgtaacggccttacccg

SEQ ID NO: 306207 - DNA, 734 bp, Homo sapiens
  misc_feature: GZ8MTXP02ITAEM.2.35.D02.1.454.CMB.2.raw
  modified_base (248)..(248): a, c, t, g, unknown or other
  misc_feature (248)..(248): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggagcagcagtgacgttggacgttataactntgtctcctggtatcaacaaccacccggaccgaaccgacccccaaactcccgtactactttactagtacggtacaacgtaacggccggtacccggttacggggtacccgtgtactccgtccttccgtcgtcggtccctccgtaagcctttggaccgtacgaaccggtccttccccgtcgtacccgttcgtcgtcggggcctaccgaaacgcgttaggacggtagtacggaaggtactaggtaactttaacgtttacgttacggacctaacggtcctaacgtaaccttaagtacggaccgaacggacgaacgacgtaacgtaacgttaacgtttacggtttaaccggtttaccggggtaaccggggtaacgggtaaccgtaaaccggtaccggttaccggtacccggttaccggtaccgggtaaccggtaaccggaacccggaaccggtacccgtaccccgtacccccggtacccggtacccgtaccg

SEQ ID NO: 306208 - DNA, 610 bp, Homo sapiens
  misc_feature: GZ8MTXP02GMXPC.2.35.D02.1.454.CMB.2.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
  modified_base (449)..(449): a, c, t, g, unknown or other
  misc_feature (449)..(449): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggagcagcagtgacgttggacggttataactntgtctctggtatcaaacaaccaccccggcgaacgcccccaaactcctcatttangagtcaactaagccggtccgttacggggtccctgactcgtcttcgtctggccctacgacgtctggcacgaacgcctccctgtaccgtcgtctcggctcagctgaggactggacgtctgtaatttacgttacgtagacacgtcctanacttaagtcgacgacgggaccgaagccgtaagaacctaaagtttcgtttaaccggtttcgggaccgggtaaacggaaccgaaacggtcgtacggtaaccgttcggacgggtaccaaccggacccgtaaggtcctcccggccccgtaccggttactaccccg

SEQ ID NO: 306209 - DNA, 688 bp, Homo sapiens
  misc_feature: GZ8MTXP02FRSO4.2.35.D02.1.454.CMB.2.raw
  modified_base (310)..(310): a, c, t, g, unknown or other
  misc_feature (310)..(310): n is a, c, g, or t
tcagacgctcgacacacgaccggtgctcgatttagcacacgatagttgggtttgggggtctcaggaggcagcgctctcaggacgtcaccaccatggcctgggctctgctcctcctcacccctcctcactcagggcacagggtcctgggcccagtctgccctgactcagcctccctccgcgtccggtctcctggacagtcagtcaccatctcctgcactggacgcagcagtgacgttggacgttataactatgtctctggtactcaacaaccgacccggacaaccgacccccaaactccctactatttagngtaacggtacctaacgtaacggccggtaccccgttaacggggtcccctacggtacttccggtacctttctccgtcggtccccctaccgtaacgtcgttggaccgaacggtaaacccggtcccctcccgtacggtacccgttccttccgtcggggaccttaccgaaacgtcgttaggacggtagtcggagggtctagtaatttacttacgtcgactagtcctacgtataagtcgacgagaccgacggactaggaactaggttacgtttacggtttacgggaccgggtacggaaaccgtacgtaccggtacggtacccgtacggtcgtaccgaacgtacccgaacggtccctacccggtccccgtacggtacttaacccg

SEQ ID NO: 306210 - DNA, 611 bp, Homo sapiens
  misc_feature: GZ8MTXP02GNOGB.2.35.D02.1.454.CMB.2.raw
  modified_base (313)..(313): a, c, t, g, unknown or other
  misc_feature (313)..(313): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggagcagcagtgacgttggcgttataactatgtactcctggtactcgaaacaacaccccggacgaacgtacccccaaaactccctataacttttangtaacggtctaacgtaacgcggtaccttaaggggtcccctgaacttcgcttctcgtcggcctacctaagtctggacacgaccggcctaccnggaccttcgtcgtacgggtcctacaagtntgagagtgaagtcagtaattacttacagctaagcttacattactgacgagtactagacgacgtacgtaagtacgttacgttacggtacgggtacggaacgtaacgtacgtacgtaccgtaccgtacggtaccgaaccgtaccgacgtaccgtacccgtacccgtaccgtaccgtaccg

SEQ ID NO: 306211 - DNA, 757 bp, Homo sapiens
  misc_feature: GZ8MTXP02HUG6O.2.35.D02.1.454.CMB.2.raw
  modified_base (249)..(249): a, c, t, g, unknown or other
  misc_feature (249)..(249): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcaggcacagggtcctgggcccagtctgccctgactcagccctccctccgcgtccggtctccgtggacagtcagtcacatctcctgcagtggagcagcagtgacgttggacgttataacgtntgtctcgtgtactacaacaaccgaccccggacgaaccgaccccctaaactccctacgtatttagcgtaggtaccaacgtaacgccggtacccgttaacgggtccctgactcgcctttacgtcgtcggtcccctaccgaacgtccgtaggacaaccggtaaacccgcccgttacccgtacgtcccggttaccgttcgggcggggtacccttaaaccgaacggtacccgtcgggtaaagggtccgttaggggtaaaccgggtaccgttagttaaaggttttacctttaacggggactaccggtaaaccggtcctttaaaccggtatttaaaacggtcggaacgtacccggggtaaacgacggtaacgtacggttaccgtttaaggtttaccggtttaccgggtacgggaaacggtaaaccggtaacgtacgtaccgtacggtaccggtaccgtacggtaccgaaccggtaccgtaccggtcccgtaccggtacccgtaccggtacctccg

SEQ ID NO: 306212 - DNA, 713 bp, Homo sapiens
  misc_feature: GZ8MTXP02G8XTG.2.35.D02.1.454.CMB.2.raw
  modified_base (340)..(340): a, c, t, g, unknown or other
  misc_feature (340)..(340): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagacgctcgacacacgaccggtgctcgatttagcacacgatagttgggtttgggggtctcaggaggcagcgctctcaggacgtcaccaccatggcctgggctctgctcctcctccaccctcctcactcagggcacgagggtcctgggcccagtatcgccctgactcacgccctccctccgcgtccggtctccgtggacagtcacgtcacctatcctcctgctacgtgggagcagcaaggtcgtacggttgggacgtttaataactagttcggtcctcgtaggttacaccgaaaccaacccgaccccggaacaacccgaccccctaaatcctatattancgacgtacacgtaacggccggtaccggttacgggtccctagactccgtcttcgtctcggtcctacgagttcacggacacggaaccgtcctccgngaccgtcncggtcggcacgtagcgtaggacgngtaggaactcgttaagtaatttactacggtacgacctagtaccttacgtaaacgttagccggtagggaacgacgaaccgtagaacggttaccttaaaggttcggtttaaccggggttacgggaacgggggtaaaaccctaccgaaccggttccggttaaccggccgttaaacccgggtcgtaaacccgggaaccgaccggtcccggttaccgcccccggttacccgtccggtttaaccttcccccgg

SEQ ID NO: 306213 - DNA, 731 bp, Homo sapiens
  misc_feature: GZ8MTXP02IR4QF.2.35.D02.1.454.CMB.2.raw
  modified_base (302)..(302): a, c, t, g, unknown or other
  misc_feature (302)..(302): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctctgcactggaggcagcagtgacgttggcgttaataactatgtctctgtatcaaacaccacccggacaacgacccccaaactcctacacttttangtacgtctaactaaacggccggtaccgttacggggtaccctagtacgtctcttctcgtcggccctacacgtcgacggacaacggacccgtccttccgtacgtacccgttccgtcgtcgggtacctaccgtaagccgtaaggaggtaggtacggtacgtacgttaggttaacgtttaatttacgacgttacgaacgttaccgtaactaatttaacgcggtaaacggcggaaccttagaaccgataaaccgtaaggttttaccggttccgtttaaacgggggtcccgggtaaaacgggaaacccgttaaagggtcccgttaaacccgggttaccgttaccccgggttaggtaaacccggtaacccggtaaacccggaaccgggttccccgttaaccccggtccccgggtttaaccctaccggtttaacccc

SEQ ID NO: 306214 - DNA, 691 bp, Homo sapiens
  misc_feature: GZ8MTXP02FMP70.2.35.D02.1.454.CMB.2.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcggttataactntgtctctgtatcaacaaccaccccggacgaacgacccccaaactcctacatttangagtcactaagcgtccgttagggtccctgactcgtctctctgcctacacgtctcggcgacgaaccggtcctcccgtcgtaccgtctcgtcggctaccgaagctacgaggactgaggtcgtagtaactttaacgttacgtagtacgaagtcctactaacttaagttccggaacgaaacggcccgtaaggacccaagtaacgttaaacgttaccggtttttaaccggtttttaccgggggaacggggttaaaccgggggaaccgtaaaacggtcccggttacgggtaacccccggttaccggtcgggggttacccgaaccggtaccccggtaaacggggtcccgttaccccgggtacccccccggttcgggttacccctttacccccgg

SEQ ID NO: 306215 - DNA, 685 bp, Homo sapiens
  misc_feature: GZ8MTXP02HFH6S.2.35.D02.1.454.CMB.2.raw
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (543)..(543): a, c, t, g, unknown or other
  misc_feature (543)..(543): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcaggcacagggtcctgggcccagtctgccctgactcagcctccctccgcgtccgggtctccgtggacagtcagtccaccatcctcctgcacgtgggagcagctaggtgacggttggtacggtttaataactagttgttcctccgtaggtacaccaaacaccgaccccgngaacccaccccctaaactcctntatttataggacgtacacgtaacgcgtacccgttacgggtccctagactcgtacgttctcgtagtccccctacgtaagtccgtacggacgtaacggtaaccccgttccctaccccgtggtaaacccccggttcgttccggttaccggggcccctttaacccggaagtcccggttaggaacgggtaaggtcggtaacggtcttaaggtactttacgttaaccgtnacgtagtcctactagttaccagacggacgagagagtaacgtactacggttacgttacggtacggaacgggtacgacacgtccgacgtaccgtccgacggtacgaaccgtaccgacgtcccgtacccgtcccgtcgacctccg

SEQ ID NO: 306216 - DNA, 784 bp, Homo sapiens
  misc_feature: GZ8MTXP02GCYQI.2.35.D02.1.454.CMB.2.raw
  modified_base (214)..(214): a, c, t, g, unknown or other
  misc_feature (214)..(214): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctncacgtggagcagcagtgacgttggacgttaatactatgtctctgtatcaaacaaccgcccggacaaccgaccccaaactcctactatttagcgacgtacaacgtacggccggtcccgttaacggggtccctaggacttcgtacttctcgtacggtcccctaccgtacgtccgtacggacaaccggtacccgtcccttaccccgtacggtacccgttcctccggtcgggtaccctaccgtaacgtccgttaggaacggtagtacgggtaacggtcttaacggttaacgtttaacttaaccgtagtaccgtaactccggtattaacgtaggttacgaccggtacggaccgtaacggaacctaccgttaaagttaaccggtttaaacggtttaacccgggttttaccggggaaccgggggaaaccggtaaacccggtaacggttacccgttaaccgggtacccccggttacggttaacccggggttaaccggtaacccggtaacccgggtaaaaccccggttccccggttacccccggtcccccggtttacccgttaacccggtttacccccg

SEQ ID NO: 306217 - DNA, 638 bp, Homo sapiens
  misc_feature: GZ8MTXP02H4CWJ.2.35.D02.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagcagcagtgacgttggcgttanactntgtctctgtatcaacacacccggacgaacgaccccaaactcctacatttangacgtcaacgtacgacggtcccgttagggtccctgacgtccgtcttctcgtcggccctaccgagtcgtacggacacggaaccggccctcccgtcggtacccgttctcgtcggggacctcccgaaagtcgtacggagagtggaagtctgttaactttagttacgtacgtacgtagtcctactactactaggccgaaggacaggtacagtacttaagttacggtttacggtttacggacggggaacggaaccgtaaacggtcgtaccggtaccgttaccggttacggaccgaaccggtacccgaacggtcccgtcccgtaccccggttcggtacccttaccg

SEQ ID NO: 306218 - DNA, 618 bp, Homo sapiens
  misc_feature: GZ8MTXP02H1P14.2.35.D02.1.454.CMB.2.raw
  modified_base (250)..(250): a, c, t, g, unknown or other
  misc_feature (250)..(250): n is a, c, g, or t
  modified_base (446)..(446): a, c, t, g, unknown or other
  misc_feature (446)..(446): n is a, c, g, or t
  modified_base (488)..(488): a, c, t, g, unknown or other
  misc_feature (488)..(488): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaggcagcagtgacggttggcggttataactntgtctctgtatcaacacaccccggacgaaccgacccccaaactcctactatttagtgacggttacaactaacggccggtccccgtttaaggggtcccctgtactccgtctttcctcgtcggtccctaccgagtcgtggactacgaaccggtccctccgacgtaccgtctcgtcgggacctacgaacgtcgtagagngtacgacgtctagtacgttatacgtgacagtctacattacgngacgaggcctagcgaacgacttagttacgtttacgtttcgggacggtacgggacctacggtacgtacgtacccgtcgtacggtacgaaccgtccgtaaacggtcctaccggtccccgtcgtccttacccg

SEQ ID NO: 306219 - DNA, 696 bp, Homo sapiens
  misc_feature: GZ8MTXP02JEVCC.2.35.D02.1.454.CMB.2.raw
  modified_base (253)..(253): a, c, t, g, unknown or other
  misc_feature (253)..(253): n is a, c, g, or t
  modified_base (472)..(472): a, c, t, g, unknown or other
  misc_feature (472)..(472): n is a, c, g, or t
  modified_base (517)..(517): a, c, t, g, unknown or other
  misc_feature (517)..(517): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcacgcctccctccgcgttccgggtctcctggacagtcagtcaccatcctctgcacgtggagcagcagtcgacgttggcgttaataactntgtctctgtatcaacaccacccggacaaccgacccccaaatcctctaatttatgtacgtacaacgtacggccggtacccgttacgggtacccgtgacttccggtacttcctcgtacggcccttaccgaagttcgtcggaccaaccggtaacccgcccgtacccctggtaccccgtcttccgtcgggtacctacccgagtccgtaggacggtagtacggnggtacttagtagtttacttagtcggtcaacgtcctacagttaacngtacgaacggacacgacgaacgtacgttaaaggttcgtttaacgggtttaaccgggtcggaaaccgggttaccgaaacggtccgtaaccgggtcccggttacggtaccggggtccgaaaccggtccccggtaaacgggtcccgttcccggtacccccggtaccggtccgtttacccccg

SEQ ID NO: 306220 - DNA, 762 bp, Homo sapiens
  misc_feature: GZ8MTXP02JGV3R.2.35.D02.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacgagggtcctgggcccagtctgccctgactcagccctccctccgcgtccgggtctccgtggacagtcagtccaccatcctcctgccacgtgggagcagcagtgtacgttggacgttaanaactntcgttctcgtaggtactacaaccncgccccgacccggacgaaaccccaccccctaaatccctattaacttgtacggtacggtacctaaacggtaccgggcccggttacccggttaccgggtcctggtaccgtccgtcttcctcggcgtacctacgagttccggcggtaccacggtacccggtccccctacggtacgtaccccgttcgtcggtccggtaccacccgtaagtccggtaaggacgggtacgtacggggttaaccgtgttaacggtttaaactttaccgtacgttccggaaactccggttcctaagttaaggtcctagggacccgacgggtaaaccgagtaacggttaactaaccggtttacgtttaccggttacggggtaccgggaaacggaacggtaaacccgtacgggttccggtacccgggttaccgttccgggtaacggaacccgtaccggtaccgtacccggtccccgtacccgtcccgtacgttaccccg

SEQ ID NO: 306221 - DNA, 637 bp, Homo sapiens
  misc_feature: GZ8MTXP02G4DAL.2.35.D02.1.454.CMB.2.raw
  modified_base (308)..(308): a, c, t, g, unknown or other
  misc_feature (308)..(308): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaaacaaccaccccggcgaaacgcccccaaaatcctacgatttancgtaaggtcaacgtaaagccggtaccccgtttaggggtcccctgaagtccgctttcctcgttcggcccttaccctaagtctcggacaggaaacgccctccctgacccgtctcgtggacctacaaagctaggagtatgggaacgtctagtaactttaattacgtcgcaagcctatattaagtgacgacggactaggctaacgctaaaagtttccgttaaacgttttccggggacggtaacggggaaccaaaacggccttacggacccgttcccgtgggggtaccaacggccccgtaaagggccttaccgcccccggttcggtactacccg

SEQ ID NO: 306222 - DNA, 546 bp, Homo sapiens
  misc_feature: GZ8MTXP02FFGS2.2.35.D02.1.454.CMB.2.raw
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (532)..(532): a, c, t, g, unknown or other
  misc_feature (532)..(532): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactggagcagcagtgacgttgcgttanactngtctcngatcaacacacccggnaacgccccaactcacatttagagtcactaagcgccgttaggccctgatcgctctcgtcggccctccaagtcgtggccacggaaccggtccctcccgtcggaccgttcctcgtgggcctaccaagtcctaggacgtancggagtctagtattaacttcgagaccagtctctattacgngaccgaggccaggaccagtactaagtcgtttaacgttcgggacgaagggacctacgcgtcgacgtccgaggtcaacgccgaggtcccnccgtccgcgtctcg

SEQ ID NO: 306223 - DNA, 643 bp, Homo sapiens
  misc_feature: GZ8MTXP02G9QS7.2.35.D02.1.454.CMB.2.raw
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
  modified_base (532)..(532): a, c, t, g, unknown or other
  misc_feature (532)..(532): n is a, c, g, or t
  modified_base (543)..(543): a, c, t, g, unknown or other
  misc_feature (543)..(543): n is a, c, g, or t
tcagacgctcgacacacgaccggtgctcgatttagcacacgatagttggggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggagcagcagtgacgttggcgttanactatgtctcgtggtatacaacaaccgaccccggacgaaccgcccccaaaactcctactaatttanacggtagtacctaacgtaacggccggtacccgtttaacggggtccctagacgtccgtctttcctcgtcgtcccctacaagtcgtacggcaacggtaacccggtcccttcccgtacggtaaccccgttcgtccgtacggggcccttaaccaaacgtcgttacggaaggacgttacggagggtactagtagtttacgttaacgtcgacgagtcctagattacgngcgaggaccanacagtactagtcgttacgttcggacgacggactacgtcgtcggtaccgtacgtcgaccgaacgtacccgacgtcccgtacccgtcccgtaccgtactccg

SEQ ID NO: 306224 - DNA, 561 bp, Homo sapiens
  misc_feature: GZ8MTXP02IIJ31.2.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagacgctcgacacacgaccggtgctcgatttagcacacgatagttgggtttgggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtccaccatctcctgcactggagcagcagtgacgttggcgttaataactntgtctctgtatcaaacaccacccggcaacgcccccaaatccnctatttangagtcaacgtaagcggtccgttagggtccctgactcgctttctctgccctccaagtctggcagaccgcctcctgaccgtctcgnggctcagcngagntgagtctagtatttagttacgtgacacgtctacgtaattacgtgacgaaagcgaaacgcgaagacctaaatttggttaccggtttcggacgggtaagggaccaagtcgtacggtaccgtcgtcggacaacggacccgaggtcctccgccccttaggtaccctaccg

SEQ ID NO: 306225 - DNA, 254 bp, Homo sapiens
  misc_feature: GZ8MTXP01CMLGV.15.27.C05.1.454.CMB.2.raw
  modified_base (254)..(254): a, c, t, g, unknown or other
  misc_feature (254)..(254): n is a, c, g, or t
tcagtctacgtagccacgaccggtgctcgatttagacgcgatcgaagggtttggggcaaagctgccctgaccctttcgggtgcgcagcctgaggatgaggctgagtattactgcttgctctcctatagtggtagttcgggtgttcggcggagggaccaagctgaccgtcctaggtcagcccaaggctgccccctggtcactctgttcccgccctcctcgctacgtagactgagcgggctggcaaggcgcatagn

SEQ ID NO: 306226 - DNA, 254 bp, Homo sapiens
  misc_feature: GZ8MTXP02HNHZQ.15.27.C05.1.454.CMB.2.raw
  modified_base (254)..(254): a, c, t, g, unknown or other
  misc_feature (254)..(254): n is a, c, g, or t
tcagtctacgtagccacgaccggtgctcgatttagacgcgatcgaagggtttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtagactgagcgggctggcaaggcgcatagn

SEQ ID NO: 306227 - DNA, 253 bp, Homo sapiens
  misc_feature: GZ8MTXP02F3D7I.15.27.C05.1.454.CMB.2.raw
  modified_base (253)..(253): a, c, t, g, unknown or other
  misc_feature (253)..(253): n is a, c, g, or t
tcagtctacgtagccacgaccggtgctcgatttagacgcgatcgaagggtttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgcctcctcgctacgtagactgagcgggctggcaaggcgcatagn

SEQ ID NO: 306228 - DNA, 253 bp, Homo sapiens
  misc_feature: GZ8MTXP02HDYIB.15.27.C05.1.454.CMB.2.raw
  modified_base (253)..(253): a, c, t, g, unknown or other
  misc_feature (253)..(253): n is a, c, g, or t
tcagtctacgtagccacgaccggtgctcgatttagacgcgatcgaagggtttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccaccctcctcgctacgtagactgagcgggctggcaaggcgcatagn

SEQ ID NO: 306229 - DNA, 501 bp, Homo sapiens
  misc_feature: GZ8MTXP01A9WSN.25.39.D06.1.454.CMB.2.raw
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
tcagactgtacagtcacgaccggtgctcgatttagtgacatctcgcagttctttggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgccagactgttgacaacgacttagcctggtaccaacagaagcctggccaggctcccaggctcctcatctatgatacttccagtagggccatggcatcccagccccgnttcagtggccaggtgggtctggggacaagagtttcnctcaccatctccagccctagagcctgaagattttgctagtttatactgtcagctcgcaagagtgcctcatntcacttcgccctggaccaaagtgattagtacaaagactgttgcttgcacntctgttcttcntcc

SEQ ID NO: 306230 - DNA, 510 bp, Homo sapiens
  misc_feature: GZ8MTXP01BWOFY.25.39.D06.1.454.CMB.2.raw
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtgaaattatgctgactcagtctccagactttcagtctgtgactccaaaggcgaaagtcaccatcacctgccggccagtcgagcattgtactaattacactggtaccagacaaaacaatcagtcacaagctcctnatcgatctgcctcccagcccatcgtcgacggggtccccngagtcagtcgcaggtgatcgtagggactgactttccaccctcaccatcgagtcgccgtaggaacctgaagtatgctagacaacatattactgtacaanagtagtagtcncctaccactactactacgttcgaccgagggaacagcgtagagtacaacaacgcgttgtcgctcgccacttactcgttcgtc

SEQ ID NO: 306231 - DNA, 509 bp, Homo sapiens
  misc_feature: GZ8MTXP01DU8H0.25.39.D06.1.454.CMB.2.raw
  modified_base (262)..(262): a, c, t, g, unknown or other
  misc_feature (262)..(262): n is a, c, g, or t
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (494)..(494): a, c, t, g, unknown or other
  misc_feature (494)..(494): n is a, c, g, or t
tcagactgtacagtcacgaccggtgctcgatttagtgacatctcgcagttctttggggaggaactgctcagttaggacccagagggaaccatggaagccccagctcagcttctcttcctcctgctactctggctcccagattccagcggcgaaactgtgttgacacagtctccagcccaccctgtcttgtctccgggggaacagccacctctcctgcagggccgccagactgttgacaacgacttagcctggtacccaaacngaagcctggccaggctcccaggctcctcatctatgatacttcagtaggccatggcatcccagcccgnttcagtggccaggtggtctgggacagatttcnctcacntcncagctagnctagagtntttgactagtttatactgtcagctccgacgaagtaagtcgcctacaattacttctactttcggccgtaggaccaaagtgtaattatacaaacgtatgttgcttgcacntctgttcttcttctc

SEQ ID NO: 306232 - DNA, 520 bp, Homo sapiens
  misc_feature: GZ8MTXP01DXSW7.25.39.D06.1.454.CMB.2.raw
  modified_base (149)..(149): a, c, t, g, unknown or other
  misc_feature (149)..(149): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcaaagtcaccatcacctgccggcagtcgagcattggtactaattacactggtaccagacaaaaacaatcagtctaccaaagctcctcatcgagtctgcttcccagcccatgtcaggggtcccctgaggttcagtcggcagtggatcgtagggacngatttcaccctnaccatcagtgctggaactgaagatgctgcaanatattactgtcaaanagagtagcgcctccacctacactacgtttcggaccgaagggaaccaagcgtaggacgtaactaacgaaacgaacgttacgtaaggtcgtcgcaccttactcgttcgtcg

SEQ ID NO: 306233 - DNA, 512 bp, Homo sapiens
  misc_feature: GZ8MTXP01C5M8C.25.39.D06.1.454.CMB.2.raw
  modified_base (147)..(147): a, c, t, g, unknown or other
  misc_feature (147)..(147): n is a, c, g, or t
  modified_base (290)..(290): a, c, t, g, unknown or other
  misc_feature (290)..(290): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
  modified_base (430)..(430): a, c, t, g, unknown or other
  misc_feature (430)..(430): n is a, c, g, or t
tcagactgtacagtcacgaccggtgctcgatttagtgacatctcgcagttctttgggggcatgagcaaaactgacaagtcaaggcaggaagatgttgccatcacaactcattgggttctgctgctctgggttccagcctcaggggtnaaattatgctgactcagtctccagacttttcagtctgtgactccaaaggcgaaagtcaccatcacctgccgggccagtcggagcattggtactaatttacactggtaccagacaaaaaaccaatcagtctaccaaagctcctnatcgagtctgccttcccagccccatgtcaggggtcccctgaggttcagtcggcagtggatcgtgggacngactttcaccctnaccatcagtgcctggaacctgaagatgctgcaaacatattactgtacaacagagtagnacctccacctcactactttcggaccaggggaaccaagcgtggacgatacaaaacgacttgtaaggctgacaccatcttgttc

SEQ ID NO: 306234 - DNA, 561 bp, Homo sapiens
  misc_feature: GZ8MTXP01AGZ57.25.39.D06.1.454.CMB.2.raw
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
  modified_base (393)..(393): a, c, t, g, unknown or other
  misc_feature (393)..(393): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccggcagtcggagcattggtactaattacactggtaccagacaaaaaccatcagtcncaaagctctcatcgagtctgcctcccagcccatgtcagggtcccctgagttcagtgcagtgatgtagggacngtactttccaccctcaccatcagtcggcctagggaaacctggaaagntcgctagacaactatattactacgtacgaacgaagtagtacgtcgtcctacctacctacctaccgtaccgttacggtaccggaacgggaaccgaacggacgtacggacggtaacgtaacgaaacgttacgttacggtcggtcgtcgaccgaccttactcgttcgtccg

SEQ ID NO: 306235 - DNA, 546 bp, Homo sapiens
  misc_feature: GZ8MTXP01ES07R.25.39.D06.1.454.CMB.2.raw
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (529)..(529): a, c, t, g, unknown or other
  misc_feature (529)..(529): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggcctcctcatctatgatactccagtaggccatggcatcccagcccgnttcagtgccaggtgggctggggacagagtttccnctcactntctcagtcctagcgctagaattntttgacttagttttatactgtacacgtcctacgacgaagtacgtcgaccctactaattacttcctaccgtttccggaccgtagggaacctaaaggtgaacttactaacgaaacgtagtggttcgcttcgcactntctcttcttcttcgtcc

SEQ ID NO: 306236 - DNA, 509 bp, Homo sapiens
  misc_feature: GZ8MTXP01B7X2M.25.39.D06.1.454.CMB.2.raw
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
  modified_base (478)..(478): a, c, t, g, unknown or other
  misc_feature (478)..(478): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccggccagtcgagcattggtactaatttacactggtaccagacaaaaaccaatcagtctaccaaagctcctnatcgagtctgccttccccagccccatcgtcacggggtcccctgaggttcagtcggcagtggatcgtgggacngatttcacttctcaacataacgtgcctaggaacctgaagatgctgacaacatacttactgtacaacgagagtagtcgcctccacctcactcgtttggccaggggaaccaagctgganatacaaacgacttgtgctgcacatcgttgtc

SEQ ID NO: 306237 - DNA, 503 bp, Homo sapiens
  misc_feature: GZ8MTXP01CVXQ7.25.39.D06.1.454.CMB.2.raw
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
tcagactgtacagtcacgaccggtgctcgatttagtgacatctcgcagttctttgggggcatgagcaaaactgacaagtcaaggcaggaagatgttgccatcacaactcattgggttctgctgctctgggttccagcctccaggggtgaaattatgctgactcagtctccagactttcagtctgtgactccaaaggcgaaagtcaccatcacctgccgggccagtcggagcattggtactaatttacactggtaaccagacaaaaaccaaatcagtctaccaaagctcctcatcgagtctgccttcccagccccatgtcaggggtcccctgagttcagtcgcagtgatctgggacngatttcaccctnaccatcagtgctggactgagangctgacacatattactgtacaacagagtagtcgctccacctccactactttggccctaggggaacctaagcctaggagaagtcaaacgacttggtggctgcacatcttgttcc

SEQ ID NO: 306238 - DNA, 558 bp, Homo sapiens
  misc_feature: GZ8MTXP01A20SG.25.39.D06.1.454.CMB.2.raw
  modified_base (284)..(284): a, c, t, g, unknown or other
  misc_feature (284)..(284): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (536)..(536): a, c, t, g, unknown or other
  misc_feature (536)..(536): n is a, c, g, or t
tcagactgtacagtcacgaccggtgctcgatttagtgacatctcgcagttctttggggaggaactgctcagttaggacccagagggaaccatggaagccccagctcagcttctcttcctcctgctactctggctcccagattccagcggcgaaactgtgttgacacagtctccagccaccctgtctttgctccgggggaacagccacccctccctcgcgacgggccgggccgacgacgtgttgacaacgacttagcctcggtaccaacagaagcctggccagcncccacggctcctcatctatgatacttcacgtagggccactgcactcccacgccgccttcagtggcacgtgggtcgtggacgtagaagtttactctcaccatcctccacgacctagacgcctgaagtattttgctaagtttnttacngtcagctcgtacaaggaagttggccctaccaatattcactttccgggcctaggggaccaaaagttgggaatacttacaaacgaacgttggtaggcttggcctaacnctctctcttactcttccgtccg

SEQ ID NO: 306239 - DNA, 541 bp, Homo sapiens
  misc_feature: GZ8MTXP01DF4I8.25.39.D06.1.454.CMB.2.raw
  modified_base (149)..(149): a, c, t, g, unknown or other
  misc_feature (149)..(149): n is a, c, g, or t
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtnaaattatgctgactcagtctccagactttcagtctgtgactccaaaggcgaaagtcaccatcacctgccggcagtcgagcatggtactaattacactggtaccagacaaaacaatcagtctaccaaagctcctnatcgagtctgccttcccagccccatcgtcacggggtccccngagttcagtcggcagtggatcgtagggacngtactttccaccctnaccatcagtcgctaggaacctgaagatgctagacaacatattactgtacaaacagagtagtcgcctccacctacactacgtttcggccgtaaggggaaccaaggcgtagggaacgtaactacgaaaacggttacttcggtgggactcggaccaccttattccgttcgtttcc

SEQ ID NO: 306240 - DNA, 532 bp, Homo sapiens
  misc_feature: GZ8MTXP01D0GYK.25.39.D06.1.454.CMB.2.raw
  modified_base (229)..(229): a, c, t, g, unknown or other
  misc_feature (229)..(229): n is a, c, g, or t
  modified_base (287)..(287): a, c, t, g, unknown or other
  misc_feature (287)..(287): n is a, c, g, or t
  modified_base (375)..(375): a, c, t, g, unknown or other
  misc_feature (375)..(375): n is a, c, g, or t
  modified_base (512)..(512): a, c, t, g, unknown or other
  misc_feature (512)..(512): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtgaaattatgctgactcagtctccagactttcagtctgtgactccaaaggcaaagtcaccatcacctgccggccagtcggancattggtactaattacactggtaccagacaaaaaccaatcagtctaccaaagctcctnatcgagtctgccttcccagcccatcgtcgacggggtcccctgagttcagtcggcaggtggatcgtagggactggactttccacccctnaacccatcgagtgccctaggaacctgaagatgctgacaaacatattactgtacaaacagaagtagtcgcctaccaccttacactacgtttcggccgaggggaacccaagctaggacgaactacgaaaacgacttggngctgccacatccgttgttcc

SEQ ID NO: 306241 - DNA, 497 bp, Homo sapiens
  misc_feature: GZ8MTXP01D0E9K.25.39.D06.1.454.CMB.2.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
tcagactgtacagtcacgaccggtgctcgatttagtgacatctcgcagttctttgggggcatgagcaaaactgacaagtcaaggcaggaagatgttgccatcacaactcattgggttctgctgctctgggttccagcctccaggggtgaaattatgctgactcagtctccagacttttcagtctgtgactccaaaggcgaaagtcaccatcacctgccggcagtcgagcattggtactaattacactggtaccagacaaaaccaaatcagtctaccaaagctcctcatcgatctgcttcccagcccatcgtcagggtcccctgagttcagtgcagtgatcngggacngtatttcaccctcaccatcagtgcctggactgagatgctgcaacatattactgtacaaacagagtagtcgctccacctcactactttggccaggggaaccaaggcctagggaagactacaaacgttcttggtgctcgccacatcgttgtc

SEQ ID NO: 306242 - DNA, 733 bp, Homo sapiens
  misc_feature: GZ8MTXP01DKTJX.25.39.D06.1.454.CMB.2.raw
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
tcagactgtacagtcacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctggggaggtccctggacgtctctcgtgagacgtcctgtggtatttagtcaggttggttctggctagtcgacctacggttcggggccccaccgagggccctaccggagggacggtaacggggggcccgtaggttgggttcggactaaggttanacggacccaatagtgaagtacggggtaaaatttntaagtaaatttattacgcgacgtacggtaccgttacgggtaagggaaccgggtacctaacttaccaaccttactacccgtaacgaacgtaacgtaaaccgttaacccgttaacccgtaatttagtttacggggttaacgtttaaacggttaaggtaaacgttcggtaccgacgtaccgtaggaacggtacggtacggtacggtccgtcggtacttacggttagtttacgttacggtggttacggacggttaagggtaacgggtagggggtaagggtttagggttaaggtttaccggttaaccgggttcccggggcg

SEQ ID NO: 306243 - DNA, 529 bp, Homo sapiens
  misc_feature: GZ8MTXP01C36D4.25.39.D06.1.454.CMB.2.raw
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (469)..(469): a, c, t, g, unknown or other
  misc_feature (469)..(469): n is a, c, g, or t
  modified_base (519)..(519): a, c, t, g, unknown or other
  misc_feature (519)..(519): n is a, c, g, or t
tcagactgtacagtcacgaccggtgctcgatttagtgacatctcgcagttctttggggagctctgagagcggagccccagccccagaattcccaggtgtttcatttggtgatcagcactgaacacagaggactcaccatggagtttgggctgagctgggttttccttgttgttattttccaggtgtccagagtgaggtgcagttggtggagtcgtgggggagcttggtccagcctggagggtccgtgagagtctcctgtgcagcctctggattcatcttcagtcgaccatacatggactgggtccncaggctcgagggagggctggagtggtgccgtatagaaatagctaagaattacaacanagaaatacgccgngtctgtgaaaggcagattacattatctanaaagagatcgaattacaaaggtaactcaactgtatctgacaaatgaacagcctaagaaaaccgngacgacggccgtagtattacgttgttcgctagggtctagacttacgggtnaacttaaccc

SEQ ID NO: 306244 - DNA, 597 bp, Homo sapiens
  misc_feature: GZ8MTXP01DEW3C.25.39.D06.1.454.CMB.2.raw
  modified_base (258)..(258): a, c, t, g, unknown or other
  misc_feature (258)..(258): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgttcttgtctccgggggaacagccacctctcctgcagggccgccagactgtgacacgacttagcctggtaccaanagaagcctggccaggctcccgaggcctcctcatctatgatacttccaggtacggccactggcactcccagcccgcttcaggtcggccaggtgggtctggggactaagagtttcnctccacctatcctccagccctagagcctagaacgtntttgactagttttactactgttcagtctccgagtaagtacgtcggcccttacgtaaattctttcctaaccgttttccgggaccccttaggggaaccctaaaggtggtaaacttaacgtaacgaaaacgtacgttggttacgggttcttacggcctaaccgtcttcgtcgttccttccgttaacttcccg

SEQ ID NO: 306245 - DNA, 589 bp, Homo sapiens
  misc_feature: GZ8MTXP01DBKKL.25.39.D06.1.454.CMB.2.raw
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagactgtacagtcacgaccggtgctcgatttagtgacatctcgcagttctttggggagctctgagagcggagccccagccccagaattcccaggtgtttcatttggtgatcagcactgaacacagaggactcaccatggagtttgggctgagcgtggtttctgtgttatttccaggtgtcagagtgaggtgcagttggtggagtctgggggagcttggtccagcctggagggtccgtgagagtctcctgtgcagcctctggattcatcttcagtgaccatacatggactggggtccnccaggctccgagggaagggctggagtgggtgcgtatagaaatagctaagagttacnccaanagaancgcgngtctgagaagcagtattcaattatctanaagagtatagtaacttaacgaaaaggtaactctaacgttagtaactcgtagaactaaagtaacgtaaacgaacgaccgtaacggaaaaccggaaacggaaacggaaccggttaccggttacgttaacgttaacgttcgttacgtaacgtacggtaacgtacgtacgttacggtaacgttaaccgtaacccg

SEQ ID NO: 306246 - DNA, 571 bp, Homo sapiens
  misc_feature: GZ8MTXP01DFDYE.25.39.D06.1.454.CMB.2.raw
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgtgacaacgacttagcctaggtaccaacagaagcctggccaggctcccgaggcctcctnatctatgatactccagtacggccatggcactcccagcccgtcttcagtggcccaggtgggtctggggacaagtagtttcnctacactatcctccagccctagacgtcctagaagtatttgacttagtttatactgtcaggctaccgacgtaagagtcgtacctacctaataccttactaccttccggtaccctcggggaacccaaaggtcggaattactaacaaacgtaacgtgttacggcttcggaacctacaattcgtattccttcttaacgttccc

SEQ ID NO: 306247 - DNA, 518 bp, Homo sapiens
  misc_feature: GZ8MTXP01AEGMH.25.39.D06.1.454.CMB.2.raw
  modified_base (339)..(339): a, c, t, g, unknown or other
  misc_feature (339)..(339): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
tcagactgtacagtcacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaaaaggtgtccactgtcaggtgcacctggtggagtctgggggagcgtggtccagcctgggagtccctgagactctcctgtgaagcctctggatttagttcagtggttctggcatgcactgggtccgccaggctccaggcaagggggccgagtggttggcagttanagcacatgatggaagttctgaatatatgcagactcgtgaagggcgattcaccatctccagagacaattcccgaanttgngtacttggaaatggtcagccttagagtcgaggactcggctctgttattacngtgcgagngttcggggaaggtggtaagtgttagttaccgggcgcgtaag

SEQ ID NO: 306248 - DNA, 535 bp, Homo sapiens
  misc_feature: GZ8MTXP01DGEOE.25.39.D06.1.454.CMB.2.raw
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
tcagactgtacagtcacgaccggtgctcgatttagtgacatctcgcagttctttgggggaggaactgctcagttaggactcagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaaccaacagaagcctggccaggctcccaggctcctcatctatgatacttcagtaggccatggcatcccagcccgnttcagtcggcagtgggtctgggaacagtgtttacnctcaccatctcagcctagagctgaagtatttgctagtttatactgtcagtcctacggacaaggtaacgtcgcctaccaattattcctaacgtttccggccctagggaaccaaagtcgatacttacgaaaacgtacttgttggctgaccaacctatcttgttccttctaac

SEQ ID NO: 306249 - DNA, 536 bp, Homo sapiens
  misc_feature: GZ8MTXP01C8KZ5.25.39.D06.1.454.CMB.2.raw
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (399)..(399): a, c, t, g, unknown or other
  misc_feature (399)..(399): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtcgtccgggggaacagcccaccctctcctgcagggccggccagactgttgacaacgacttagcctggtaccaacagaacgcctggccaggcctcccaggctcctnatctatgatacttccaggtacggccactggcactcccagccccgnttcagtggccaggtggggtctggggacaagtagtttcnctcaccatcctcagcctagncctgaatattttgacttagttttattactgtcagtctccgagaagtagtcgcctacaatcttctacttcggccctaggaccaagtcgattatacaaacgaactgttaggcttgcacnttcgtnttcttcnctttccc

SEQ ID NO: 306250 - DNA, 533 bp, Homo sapiens
  misc_feature: GZ8MTXP01BLUU4.25.39.D06.1.454.CMB.2.raw
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccggccagtcgagcattggtactaatttacactggtaccagacaaaaaccaatcagtctcaaagctcctnatcgagtctgccttcccagccccatcgtcacgggggtcccctgagttcagtcggcagtggatcgtgggacngactttccaccctcaccatcgagtgcctggaacctgaagatgctgacaacatatactgtacaacagagtagtgcctccacctacactacgtttgggaccctagggggaacccaaggcgtagggacgtactacaaacgacttggtaacggctcggcctaccgattccgttgttccc

SEQ ID NO: 306251 - DNA, 543 bp, Homo sapiens
  misc_feature: GZ8MTXP01EYD2O.25.39.D06.1.454.CMB.2.raw
  modified_base (334)..(334): a, c, t, g, unknown or other
  misc_feature (334)..(334): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtacggccactggcatcccagcccgtnttcagtggccaggtgggctgggacaagagtttcnctcacntctcanctagcnctagagtntttgactagtttatactgtcacgtctcgacgaagtagtcgacctactaattcttcctacgtttccgccgtacgggaacctaaggtcgtaattactaacgaaacgtacgtcgttggcttcgaacactaactctcgttcttcgttcgtccg

SEQ ID NO: 306252 - DNA, 677 bp, Homo sapiens
  misc_feature: GZ8MTXP01EMBWV.25.39.D06.1.454.CMB.2.raw
  modified_base (286)..(286): a, c, t, g, unknown or other
  misc_feature (286)..(286): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctccctgcgacggccggccagactgttgtacaacgacttacgtcctggtaccaacaagaagacctggccgacggcncccaggctcctcatctatgatacttctagtacggccactgtcgactacccacgcccgcttctagtggcaggtgggtcgtggacgagtaagtttactctcaccactctccacgcttagactcccgtagtaaagtattttcgagtaacgttttatttactgtacgacgtccttaccgaccgaaagggtaaggtcgggtaccctaccaaatttacttccgtaaccgttttcccggggacccgttacgggggaaacccgtaaaaacggttcggggaaatttaacttaacccggtaaaaaccgttaaacccgttcggtttagggggacccttcggaaccctaaccctaacttcgttaaccgttcctttaccctaacctttcccggtttcccccccg

SEQ ID NO: 306253 - DNA, 529 bp, Homo sapiens
  misc_feature: GZ8MTXP01DBHND.25.39.D06.1.454.CMB.2.raw
  modified_base (367)..(367): a, c, t, g, unknown or other
  misc_feature (367)..(367): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
tcagactgtacagtcacgaccggtgctcgatttagtgacatctcgcagttctttggggaggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccgccagactgttgacaacgacttagcctggtacccaaacagaagcctggccaggctcccaggctcctcatctatgatacttccagtagggccatggcatcccagcccgcttcagtggccaggtgggtctgggacagagtttcnctcaccatcctccagccctagagcctgaagtattttgctagtttattactgtcagctccgacgaaagagtcggcctccaattacttcactttcggcccttgggaccaaagtcggattatacaaacgtaactgttggcttgcacctntctnttcttcncttcc

SEQ ID NO: 306254 - DNA, 568 bp, Homo sapiens
  misc_feature: GZ8MTXP01DECDW.25.39.D06.1.454.CMB.2.raw
tcagactgtacagtcacgaccggtgctcgatttagtgacatctcgcagttctttggggggcatgaacaaaactgacaagtcaaggcaggaagatgttgccatcacaactcattgggtttctgctgctctgggttccagcctccaggggtgaaattatgctgactcagtctccagactttcagtctgtgactcaaaggcgaaagtcacatcactgccggcagtcgagcattgtactaattacactggtaccagacaaaacaatcagtctacaaagctcctcatcgagtctgccttcccagcccatgtcgacggggtcccctgagttcagtggccaggtggatcgtgggaactagtaactttccaaccccttcaaccatcaggtcggcctaggaacctgaagactgctagactaaacatacttatacgtacaaacgtagtaagtagtactacctccacctacaacctcgtttacgggaccgaacgggggacccaaaggcgttagggaaacgaacgtaaacgaaacgttacgttcggttacggtctacgaaccactattcgtcgttcctcg

SEQ ID NO: 306255 - DNA, 597 bp, Homo sapiens
  misc_feature: GZ8MTXP01EAV9G.25.39.D06.1.454.CMB.2.raw
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccacctctcctgcagggccggccagactgttgacaacgacttagcctaggtaccaaacagaagcctggccaggctcccaggctcctcatctatgatacttccagtacggccatggcactcccagcccgnttcagtggccaggtgggtctgggacaagtagtttcnctcaccatcctccagcctagacnctagaagtntttgctaagtttatactgtcagtactccggacaaagtaaggtcggaccctaccaaattcttactaaccgtttccggcccgttaggggaaccctaaaaggtggtaaacttaagtaaccgaaaaaccgtaaagttcggttagggtttcgacctaacccgtattcgttcgtctttactaacgtttccctttaaccccg

SEQ ID NO: 306256 - DNA, 625 bp, Homo sapiens
  misc_feature: GZ8MTXP01C036A.25.39.D06.1.454.CMB.2.raw
  modified_base (381)..(381): a, c, t, g, unknown or other
  misc_feature (381)..(381): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgctccgggggaacagccaccctctcctgcagggccgccagactgtgacaacgacttagcctggtaccaacagaagcctggccaggcctcccgaggctctcatctatgatacttcagtacggccactggcactcccagccccgtcttcaggtcggcccagggtgggtctagggggacaaggtagtttaaccnctccaccatcctccagcctagagcctagaagtatttgacttagtttattacgtgtacacgtcttaccgacgtaacgaacgttcggaccctacctaaattacttaccgtaaccgttttccgggccccgttacggggtaacccgtaaaggtcgggtaattaacttacgaaaacgtaaccgtggttacggttcttacggaacctaacctcgttccttacgtttcccgttaacgttaacgtttccccg

SEQ ID NO: 306257 - DNA, 507 bp, Homo sapiens
  misc_feature: GZ8MTXP01ALY9U.25.39.D06.1.454.CMB.2.raw
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtgaaattatgctgactcagtctccagactttcagtctgtgactccaaaggcaaagtcaccatcacctgccggccagtcgagcattggtactaatttacactggtaccagacaaaaccaatcagtctaccaaagctcctcatcgagtctgcttcccagccccatgtcaggggtcccctggagttcagtcggcagtggatcgtagggactgactttccaccctcaccatcagtgcctggactgagatgctgacaacatattactgtacaacagagtagtcgctccacctcactcgtttcggcccgaggggaaccaagcgtaggagactacaaacgacttgtggctcgccacactcttgttcc

SEQ ID NO: 306258 - DNA, 587 bp, Homo sapiens
  misc_feature: GZ8MTXP01D9ZFK.25.39.D06.1.454.CMB.2.raw
  modified_base (257)..(257): a, c, t, g, unknown or other
  misc_feature (257)..(257): n is a, c, g, or t
  modified_base (361)..(361): a, c, t, g, unknown or other
  misc_feature (361)..(361): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccacctctcctgcagggccgcagactgtgacacgacttagcctggtaccaanagaagcctggccaggctccaggctcctcatctatgatacttccagtacggccatggcatcccagccgcttcagtcgccaggtggtctggggacagtagtttccnctacacctatccgacagtcctagacgtactagtagttatttacgacttagtttatacgtgtacagtcctaccgacgaaggtacgtccgaccctactaattcgttacctaccgtttccggtacccgtagggaaaccgtaaggtaacgtaacttaactaaccgttaaacgtacgttggttacgcttacgccctactaacttccgtgttaccttaaccttaacttcccg

SEQ ID NO: 306259 - DNA, 508 bp, Homo sapiens
  misc_feature: GZ8MTXP01C9JWU.25.39.D06.1.454.CMB.2.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
tcagactgtacagtcacgaccggtgctcgatttagtgacatctcgcagttctttggggagctctgagagcggagccccagccccagaattcccaggtgtttcatttggtgatcagcactgaacacagaggactcaccatggagtttgggctgagctgggttttccttgttgttattttccaggtgtccagagtgaggtgcagttggtggagtctgggggagcttggtccagcctggagggtccgtgagagtctcctgtgcagcctctggattcatcttcagtgaccatacatggactgggtccncaggctcgagggagggctggagtggtgcgtatagaatagctagagttacncacagaatcgcgntcngtgaaaggcagattcattatctacaagagatgaattcaaaggtaactcactagtatctagcaaatgaacagcctagaaaaccgnggacacggccgtagtattacgttgttgngtagtcagacttacgtcgcttaaccc

SEQ ID NO: 306260 - DNA, 619 bp, Homo sapiens
  misc_feature: GZ8MTXP01E05TW.25.39.D06.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacagcccacccctccctcgcgacgggccggccgacgactgttgtacaacgacttagcctcgtacaacagagacctgcgacgcncccacggctccncatctatgatactctagtaggccactagcactcccacgccgccttcacgtggcgtacggtgggtcgtgggacgagtaacgtttactctcaccactcgtccacgctacgagtccctagtaaggtattttgtacctaagttttattttacgcggtctacgaccttccggacaaaggggtaaacgttcgggtaccctacctaaattccttcgttaaccgtttccggggtcccgaggggaaccctaaaggtgggaacttaattaccgaaaaccgttagtcgtgggcttcggaccaacctatcttcgtacttcaactttccgtcccc

SEQ ID NO: 306261 - DNA, 540 bp, Homo sapiens
  misc_feature: GZ8MTXP01BL7DC.25.39.D06.1.454.CMB.2.raw
  modified_base (262)..(262): a, c, t, g, unknown or other
  misc_feature (262)..(262): n is a, c, g, or t
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtctccgggggaacagccaccctctcctgcagggccgccagactgttgacaacgacttagcctggtaccaanagaagcctggcccaggcctcccaggctcctcatctatgatacttccagtacgggccactggcactcccagccccgnttcagtggccaggtggtctgggacaaggtagtttcnctcaccatcctccagtcctagagcctagaacgtnttttgacttagttttattactgtcagctccgacgaagtaagtcgacctacctaatacttctacgttcggccctagggaccaaaggtgattagtacaaacgactgngcttgcacntctgttcttcaacttccc

SEQ ID NO: 306262 - DNA, 541 bp, Homo sapiens
  misc_feature: GZ8MTXP01BEADB.25.39.D06.1.454.CMB.2.raw
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
  modified_base (431)..(431): a, c, t, g, unknown or other
  misc_feature (431)..(431): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccggccagtcggagcattggtactaattacactggtaccagacaaaacaatcagtctacaanctcctnatcgatctgccttcccagcccatcgtcgacggggtcccctgaggttcaggtcgcagtggatcgtagggacngtactttcaccctcacatcagtcgctacggactgaagatgctgacaacattatactgtacaacgagtagtagtcncctccacctactacgttaccgtttcgggacccgaacgggggaacccaaaggttcgtaggagtaactaacgaaacgacttcggtggtctcggcaccttatccttaagtccc

SEQ ID NO: 306263 - DNA, 499 bp, Homo sapiens
  misc_feature: GZ8MTXP01AGWQY.25.39.D06.1.454.CMB.2.raw
  modified_base (369)..(369): a, c, t, g, unknown or other
  misc_feature (369)..(369): n is a, c, g, or t
  modified_base (460)..(460): a, c, t, g, unknown or other
  misc_feature (460)..(460): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgctgggccagtcggagcattggtactaatttacactggtaccagacaaaaaccaaatcagtctaccaaagctcctcatcgagtctgcttcccagccccatgtcaggggtcccctgaggttcagtggcagtggatctgggcagatttcaccctnaccatcagtgctggaactgaagatgctgacaacatattactggtcaaacagagtagtgctccacctctacactttgccaagggaccaagcnggagacttacgaacgactggtgctgcactaacttcttcg

SEQ ID NO: 306264 - DNA, 826 bp, Homo sapiens
  misc_feature: GZ8MTXP01ELU0L.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgttctttgtcgtccgggggaacagcccaccctctcctgcagggccgccagactgttagacaacgacttagcctaggtaaccaaacgagaagccctggacccagggccctccccgaggcctccctcacttcctaatgaaacttacctttacccaaggttacggggccctaacgttcgggacctacccttcccccgaacggtccccccgtactttccgaacggttcgggacccgtaggggttcgggggttccgtaggggggaaaccctaaaagggttaacgtttttaaccctcccttaccaaacccctaactttccccgtaccccgaaacggtccccttaaaggaccgtacccgttagggtaaacgtttaactttttgggaaccctttaaggttttttaaacttaccgttggtacctacggtacccttaccccggaacggtaaaaggttaaacgggttccggtacccctttaaaccgtaaacgtttacctttacccggttaaacccgtttttccccggggaaccccgtttacggggaaaaccccgttaaaagggtaacggtaaattaactaaaccgaaaaaccgtaacgttggttacggttcttacgaacctacctaattccgttattccttcttaacgttcccc

SEQ ID NO: 306265 - DNA, 677 bp, Homo sapiens
  misc_feature: GZ8MTXP01AJPLK.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgccagactgttgacaacgacttagcctaggtaccaacagaagcctggccagggctcccgaggcctcctcatctatgatacctccaggtacggccacgtggctactcccgacgccccgtcttcgaggtcggcccgtagggtcggggtcgtcggggacaaggttacgtttcctcctccaacctactcctaccgacgtccctaggacgtccgtaggtaagttacgttttgtaccgtttaagttttaacttacgtacgttacgacgtccgtaccgaacggtaaaggtaacgggttccgtacccttaaccgtaacttactttaccgttaccgtttcccgggtcccgtaacggggtaaaccctaaagggtaacggtaaacttacgtaaaccgaaacggtaacgttggcgggttacttcgaacctacctaacttcggttccttactttccgctttccccg

SEQ ID NO: 306266 - DNA, 519 bp, Homo sapiens
  misc_feature: GZ8MTXP01AQ4JL.25.39.D06.1.454.CMB.2.raw
  modified_base (259)..(259): a, c, t, g, unknown or other
  misc_feature (259)..(259): n is a, c, g, or t
  modified_base (366)..(366): a, c, t, g, unknown or other
  misc_feature (366)..(366): n is a, c, g, or t
  modified_base (513)..(513): a, c, t, g, unknown or other
  misc_feature (513)..(513): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgccagactgttgacaacgcttagcctggtaccaanagaagcctggccaggctcccaggctctcatctatgatacttccagtaggccactggcatcccagcccgcttcagtggcccaggtgggtctggggacaagtagtttcnctcaccatctcagccctagagcctagaacgtattttgactagtttacttactgtcagctccgcaagagtgcctcaatactcactttcgcctggaccaaagtgattatacaaacgtactgttcggcttcgcacctaatctgttcttcnttcccg

SEQ ID NO: 306267 - DNA, 577 bp, Homo sapiens
  misc_feature: GZ8MTXP01B6MYM.25.39.D06.1.454.CMB.2.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (559)..(559): a, c, t, g, unknown or other
  misc_feature (559)..(559): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagatagcaccggagaagttgtgttgacacagtctccagaccaccctgtctttgctccgagggggaaancgccaccctctcctgcagggccagtcagagtgttatcaggtacttagcctaggtaaccaacacgaaacctggccaggctcccaggcctcctnatctatgatgcataccgaaggacgggccacgtggcactccccaagcccgtaggttccaggtggctagggtcggggctaggggcaggtagttccactctacacatcagcagtctgganccgtagaagttntttgacttagtttattactagggtcaggtcagtacgtagcgtaggttcggccgttccgggtactacgggtttcggaaccggtaagggaccaaggcgtaggacgaacgttcgaaacgtaagtggtaacggtcncggacctaacgttcttcg

SEQ ID NO: 306268 - DNA, 570 bp, Homo sapiens
  misc_feature: GZ8MTXP01C0ZSX.25.39.D06.1.454.CMB.2.raw
  modified_base (202)..(202): a, c, t, g, unknown or other
  misc_feature (202)..(202): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtctccggggaacngccacctctcctgcagggccgccagactgttgacaacgacttagcctggtaccaacagaagcctggccaggctcccaggctcctcatctatgatacttccagtacggccatagcactcccagcccgnttcagtgccaggtgggtctgggacaagtagtttcnctcacctatctccagcctancgcctagaagtntttgacttagtttatactgtcagcctccgagaagtaacgtgaccctacaatacttctaacgtttccggaccccttagggaacctaaaggtcggtaattactaacaaacggtaactgttcggttcttacggaacctaaacccgttcttcgtcgttaccttccgttaacgttcccg

SEQ ID NO: 306269 - DNA, 531 bp, Homo sapiens
  misc_feature: GZ8MTXP01D2AVT.25.39.D06.1.454.CMB.2.raw
  modified_base (148)..(148): a, c, t, g, unknown or other
  misc_feature (148)..(148): n is a, c, g, or t
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
  modified_base (402)..(402): a, c, t, g, unknown or other
  misc_feature (402)..(402): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctggttccagcctccaggggtnaaattatgctgactcagtctccagtactttcagtctgtgactccaaaggcaaagtcaccatcacctgccggcagtcgancattgtactaattacatggtacagacaaaaacaatcagtctaccaaancctacctnatcgatctgcttcccagcccatgtcacgggtccctgagttcagtcgcagtcgatcgtagggacngattcaacctcaacntcagtgcctgaactgaagatgctanacaatatattacgtntaacgaagtagtagtacgtcgcctcctactactacgttacgttaccggaccggaacgggtaaccagcgtaggaaacgtaacgtaacgaaacgttcgttacggtcgtactcgacacttactcgttcgtcg

SEQ ID NO: 306270 - DNA, 508 bp, Homo sapiens
  misc_feature: GZ8MTXP01BHWSZ.25.39.D06.1.454.CMB.2.raw
  modified_base (332)..(332): a, c, t, g, unknown or other
  misc_feature (332)..(332): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccatggcatcccagcccgnttcagtggccaggtgggtctggggacaagagtttcnctcaccatctccagccctagagcctgaatntttgactagtttatactgtcagctcgagaagagtcgcctacaatntcacttcgcctggaccaagtgattatcaaagactgngcttgccacaactctcgttctcncttccc

SEQ ID NO: 306271 - DNA, 522 bp, Homo sapiens
  misc_feature: GZ8MTXP01B85J2.25.39.D06.1.454.CMB.2.raw
  modified_base (355)..(355): a, c, t, g, unknown or other
  misc_feature (355)..(355): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtgaaattatgctgactcagtctccagactttcagtctgtgactccaaaggcaaagtcaccatcacctgccggcagtcgagcattggtactaattacactggtaccagacaaaaaccaatcagtctacaaagcctcctcatcgagtctgccttcccagccccatcgtcacggggtcccctgaggttcagtcggcagtgatcgtgggacngatttccaccctcaccatcagtcgcctaggaacctgaagatgctgacaaacataattactagtacaaactagagtagtcgcctcccacctacactacgtttggacccgaggggaacccaagctaggagtaatacgaaacgattggtaagctgcaccatcgttgttcc

SEQ ID NO: 306272 - DNA, 590 bp, Homo sapiens
  misc_feature: GZ8MTXP01DGQXN.25.39.D06.1.454.CMB.2.raw
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtctccgggggaacagccacctctcctgcagggccgccagactgttgacaacgacttagcctggtaccaaacagaagcctggccaggctcccaggctcctcatctatgactacttccagtacgggccagtggcactccccagccccgtnttcaggtcggccaggtgggtctggggactaaggtacgttttccnctaccacctatcctcacgtcctagacgtcgtagtaagttatttagacttagtttattacgtgtacacgtacctacgacggtaaacgtagtcgtacctactaattcttacgtaccgttccgtccgtacggaaccaaaggtaacgtaattaacgtaacgaaacgtacgtgttacgcttacgaaccactcttctcgttccttcttcttcccg

SEQ ID NO: 306273 - DNA, 529 bp, Homo sapiens
  misc_feature: GZ8MTXP01APSKK.25.39.D06.1.454.CMB.2.raw
  modified_base (365)..(365): a, c, t, g, unknown or other
  misc_feature (365)..(365): n is a, c, g, or t
  modified_base (429)..(429): a, c, t, g, unknown or other
  misc_feature (429)..(429): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggccaggctcccaggctcctcatctatgatactcagtaggccatggcatcccagcccgcttcagtggccaggtgggtctggggacaaggagtttcnctcaccatcctccagccctagagcctagaagtatttgactagtttaggtactgtcagctaccgngaagaagtcgacctacctaatattctactttcggcccgtaggaccaaagtggattaagtacaaacgtaactgttggcttgcaccntcctnttctcnctcc

SEQ ID NO: 306274 - DNA, 579 bp, Homo sapiens
  misc_feature: GZ8MTXP01CT7LJ.25.39.D06.1.454.CMB.2.raw
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgctccgagggaacagccacctctctgcagggccgcagactgtgacaacgacttagcctggtaaccaacagaacgcctggccaggctcccagctccnatctangatactcagtaggccatgcactcccagcccgnttcgagtcggctaggtgggtctggggaaacagtaacgtttacnctccaaccatcctaccagccctaagacgcctagaaagttattttacgacttagtttacttactggttacagtcctcgggacaaagtacgtcgcctaccaattattacctacgtttccggaccctagggaaccctaaaaggttcggaattaaacgttaacgaaaacgtaacgttgttggacttcgacctaacctagtcttcgtccttcgtaaccc

SEQ ID NO: 306275 - DNA, 565 bp, Homo sapiens
  misc_feature: GZ8MTXP01EH8S0.25.39.D06.1.454.CMB.2.raw
  modified_base (151)..(151): a, c, t, g, unknown or other
  misc_feature (151)..(151): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtnaaattatgctgactcagtctccagacttttcagtctgtgactccaaaggcaaagtcacatcacctgccggccagtcgagcattggtactaatttacactggtaccagacaaaaaccaatcagtctaccaaagctcctnatcgagtctgccttccccagcccctatcgtccgacgggggtccccctggaggttcaggtcggctaggtggatcgtagggacngtactttccaccctcaccatcgagtcgctggaacctgaagatgctgacaactatacttactgtaccaatagtagtagtcgcctccacctactactacgtttcggaccgaaggggaacccaaggttcgtagggaagaacgtaacgaaaacggttacttggttgggcctggaccaccgttacttccgttcgtttcc

SEQ ID NO: 306276 - DNA, 586 bp, Homo sapiens
  misc_feature: GZ8MTXP01AXTZ4.25.39.D06.1.454.CMB.2.raw
tcagactgtacagtcacgaccggtgctcgatttagtgacatctcgcagttctttggggagctgtgggcttaggaagcagagcctggggcatctccaccatggcctggacccctctcctcctccagcttctcaccctctgctcagggtcctgggcacagtctgcgctgacccaggaagactcggtgtcggggaccgtgggacagaaagtcaccctgtcttgttctggtacgagcgacaaacattggaacgtatcctggtgggctggtaccaacagaatggtcaccggtcccccaaaatgtgatgtctggagatgttccgccctgagggactccctgcccgcttctcgtggggtcaggtgtcgtcgggacccacgaacgccctcccgtgacctagtccggccgggcctcacgccgtgacggcgaggctcggtactactgctcagcagtcgggactcgtgacgcgtcgcgtgctcgcggtcgttccggggcgggggtcccgtcggacccgttccgtaggttccgacgcccgaaggccttccggcccccgtcgggtccacgttccgttccgttccccgcccgttaacccg

SEQ ID NO: 306277 - DNA, 545 bp, Homo sapiens
  misc_feature: GZ8MTXP01A8WNU.25.39.D06.1.454.CMB.2.raw
  modified_base (254)..(254): a, c, t, g, unknown or other
  misc_feature (254)..(254): n is a, c, g, or t
  modified_base (481)..(481): a, c, t, g, unknown or other
  misc_feature (481)..(481): n is a, c, g, or t
  modified_base (508)..(508): a, c, t, g, unknown or other
  misc_feature (508)..(508): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttattttccaggtgtccagagtgaggtgcaggttggtggagtcgtggggggagcttggtccagcctgggagggtccgtgagngtctcctgtgcagcctctggattcatcttcagtcgaccactacatggactggggtccgccaggctccgaggggaagggctggagtgggtgccgtattagaaataagctaagaagttacaacacagaatacgccgcgtctgtagaaagcagattcattatctacaagagactgaattacaaaggaactcactagtatctgacaaatgaaacagacctaagaaaaccgnggacgacgggccgtagtattacgttgngtcgtaggtcagtacttacggtcgttaacttaacccc

SEQ ID NO: 306278 - DNA, 735 bp, Homo sapiens
  misc_feature: GZ8MTXP01B0DRS.25.39.D06.1.454.CMB.2.raw
  modified_base (266)..(266): a, c, t, g, unknown or other
  misc_feature (266)..(266): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgtcgtccgggggaacgagccaccctctcctgcacgggccgccagactgttgacaacgtacttagcctaggtaccaaanagaacgcctggccaggcctcccgaggcctcctcatctatgatacttccagtcggccacgtggcactcccacgccccgtcttcgaggttcggcccgtagggttggggtcgtacggggacctaaaggttacgttttaacctctaccaccctactcctcccaagtccccttaagacgtccgttaggaaacgttcttttaggaccttaaggtttttaacttaccgttgttaccgaacgtccgttaacccggacgggtaaaacgtaaaccgggttcggtaaccccttaaccgtaaactttactttacccgttaaaccccgttttcggggacccccgttaacggggtaaacccgtaaaaggggtaacggtaaacttaaacgttaacccgaaaaacgggtaaaccctgggttacgggaccttacggaacctacccgtaattcccgttacggttccttaaccgttaactttcccccg

SEQ ID NO: 306279 - DNA, 607 bp, Homo sapiens
  misc_feature: GZ8MTXP01DYLMY.25.39.D06.1.454.CMB.2.raw
  modified_base (149)..(149): a, c, t, g, unknown or other
  misc_feature (149)..(149): n is a, c, g, or t
  modified_base (305)..(305): a, c, t, g, unknown or other
  misc_feature (305)..(305): n is a, c, g, or t
  modified_base (360)..(360): a, c, t, g, unknown or other
  misc_feature (360)..(360): n is a, c, g, or t
  modified_base (485)..(485): a, c, t, g, unknown or other
  misc_feature (485)..(485): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctcgaggggtnaaattatgctgactcagtctccagtactttcagtctgtgactaccgaaaggcgaaagtcacatcaccgtgccgggcagtcggagctagttggtaactaattacactaggtaaccaagaacaaaaaaccaatcaagtacctaccaaagcctacctanatcgagtctgcccttacccagcccatcgtcgacgggtcccctgaggtcagtcggnaggtgatcgtagggactgtcttccaccctcaccagtcgaggtcggacctacgggaacctaggaaacgtatcggactacgactaaactattaacttactacgtaacaaacgtaggtagtacggtcnccctaccctacctaccgtacttaccgtttacgggacccgtaagggggaacccaaggcgtaggaacgtaactaacgaaaacggttcgttcggtcgctcggccaacgttacttccgttgttccc

SEQ ID NO: 306280 - DNA, 541 bp, Homo sapiens
  misc_feature: GZ8MTXP01CBQQU.25.39.D06.1.454.CMB.2.raw
  modified_base (149)..(149): a, c, t, g, unknown or other
  misc_feature (149)..(149): n is a, c, g, or t
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtnaaattatgctgactcagtctccagactttcagtctgtgactccaaaggcgaaagtcaccatcacctgccggcctgtcggagcattggtactaatttacactggtaccaagacaaaaaccaatcagtctacaaagctcctnatcgatctgccttccccagccccatcgtcgacggggtccccctgaggttcagtcggcagtggatcgtagggacngtactttccaccctnaccatcagtcgcctaggacctgaagatgctgacaacatattactgtacaacagtagtagtcncctccactacactacgtttggacccgaaggggaaccaaggcgtagggagtaacgtacgaaaacggttacttggtggctgaccaccttatccgttgttaacc

SEQ ID NO: 306281 - DNA, 614 bp, Homo sapiens
  misc_feature: GZ8MTXP01BZCAM.25.39.D06.1.454.CMB.2.raw
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctccagattccagcggcgaaactgtgttgacacagtctccagccaccctgtctttgtcgtccgggggaacagccaccctctcctgcgagggccggccagactgttagacaacgacttagcctaggtaaccaaagagaacgcctggccaggcctcccaggcctcctcatctatgatacttccagtacggccactcggcactcccagcccncttcagtgccaggtgggtctggggacaagtacgtttcnctccacctatcctcccagtacccttagagtcttaggaagttacttttagacttagttttattaacgtgtcaacgtcttaccgaccggtaaagtaacggtcgacctacctaaatttacttccttacgtttccggtacccgtagggtaaaccctaaggtaaggaacttaagttacgaaacgtaacgtgttcggcttcggcctaacccaattccgtgttacttcttaacgtttcccc

SEQ ID NO: 306282 - DNA, 554 bp, Homo sapiens
  misc_feature: GZ8MTXP01EJRSC.25.39.D06.1.454.CMB.2.raw
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacagccacctctcctgcagggccgccagactgttgacaacgacttagcctggtacccaaacagaagcctggccaggcctcccaggcctcctcatctatgatacttccagtacggccacgtggcactcccagccccgcttcgagtgcccaggtgggtctgggacaagtacgtttctctcacctatcctccgagtccctagacgtcctaggaaagttacttttgacttaagttttacttactgtcagtcctaccgacgaaagaacggtcgaccctacaattacttctacgttccggccctaggaccaagtgattagtacaaacgactgagcttgcactntctnttctcttctcc

SEQ ID NO: 306283 - DNA, 620 bp, Homo sapiens
  misc_feature: GZ8MTXP01CKR63.25.39.D06.1.454.CMB.2.raw
  modified_base (263)..(263): a, c, t, g, unknown or other
  misc_feature (263)..(263): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacagccaccctctcctgcgagggccgccagactgttgacaacgacttagcctggtaccaanagaagcctggccaggctcccaggcctcctcatctatgatactccagtacggccactggcactcccagccccgnttcagtggcccaggtgggtctggggactaaggtacgtttcnctaccacctatccgtaccagccctagacgcctagagttatttgacttagtttatactgtacagctacgacgtaagtagtcgtacctacctaattacttccgtaaccgtttccggacccgttacggggaaaccctaaaggtgggtaacttaacgtaacgttaaaaccgtaacgttgggttacggccttcggaaccctaacctaacgttccgttcgttccctttaaccgttaaccgtttcccccg

SEQ ID NO: 306284 - DNA, 539 bp, Homo sapiens
  misc_feature: GZ8MTXP01CU6SM.25.39.D06.1.454.CMB.2.raw
  modified_base (149)..(149): a, c, t, g, unknown or other
  misc_feature (149)..(149): n is a, c, g, or t
  modified_base (286)..(286): a, c, t, g, unknown or other
  misc_feature (286)..(286): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
  modified_base (394)..(395): a, c, t, g, unknown or other
  misc_feature (394)..(395): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctcaggggtnaattatgctgactcagtctccagtacttttcagtctgtgactaccaaaggcaaagtcaccatcactgccggcagtcgagcattgtaactaattacactggtaccagacaaaaacaatcagtctaccaaagcctcctnatcgagtctgccttccccaagcccctagtcgtccgacgggggtccccngaggttcagtcgcagtgatgaggacngtacttcaccctcacatcagngctgactgaanannctgacaacatattactagtacaacagtaagtagtcgcctaccacctactactaccgtttcggaccgtaacgggaacaacggcgtaggaagtaactaacgaacgttacgttcgtaacggactcgaccaccttacttcttcgttcc

SEQ ID NO: 306285 - DNA, 536 bp, Homo sapiens
  misc_feature: GZ8MTXP01AC4VA.25.39.D06.1.454.CMB.2.raw
  modified_base (227)..(227): a, c, t, g, unknown or other
  misc_feature (227)..(227): n is a, c, g, or t
  modified_base (284)..(284): a, c, t, g, unknown or other
  misc_feature (284)..(284): n is a, c, g, or t
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (492)..(492): a, c, t, g, unknown or other
  misc_feature (492)..(492): n is a, c, g, or t
  modified_base (515)..(515): a, c, t, g, unknown or other
  misc_feature (515)..(515): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcactgccggcagtcgancattggtactaatttacactggtaccagacaaaaccaatcagtctacaaagctcctnatcgagtctgccttccccagccccatcgtccgacgggggtccccngaggttcagtcgcngtggatcgagggacngtcttccaccctcaccatcgagtcgcctaggaacctgaagtatcgctagacaactataattactagtaccaaanagtagtagttcncctccacctcacttacgtttcggccgacggggaaccaaggcgtagganacgtacaaacgttcttggtggcncgccaccttatccgttgttcc

SEQ ID NO: 306286 - DNA, 530 bp, Homo sapiens
  misc_feature: GZ8MTXP01D39FH.25.39.D06.1.454.CMB.2.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
tcagactgtacagtcacgaccggtgctcgatttagtgacatctcgcagttctttggggggcatgagcaaaaactgacaagtcaaggcaggaagatgttgccatcacaactcattgggttctgctgctctgggttccagcctcgaggggtgaaattatgctgactcagtctccagtactttcagtctgtgactaccgaaaggcaaagtcaccatcacctgccggcagtcganctatgtactattacatgacagacaaaacatcatcacaanctcanatcgatctgcctccagccatcgcgacgggtccctgagtcagtgcagtgntcgtaggacngtacttcccaaccctcacatcgagtcgctaggacnganatgctagacaatatatactgtaaccaagtagtactagtcaccctcccaccttactacctcgtttacggccgaaggggaacccaaggttcgtaggaacaacgtaaccgaaaacgttacgttggtaacggcctgacccacttacttccttcgtttaaccc

SEQ ID NO: 306287 - DNA, 579 bp, Homo sapiens
  misc_feature: GZ8MTXP01AJ0XG.25.39.D06.1.454.CMB.2.raw
  modified_base (150)..(150): a, c, t, g, unknown or other
  misc_feature (150)..(150): n is a, c, g, or t
  modified_base (364)..(364): a, c, t, g, unknown or other
  misc_feature (364)..(364): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctcgaggggtnaaattatgctgactcagtctccagtactttcagtctgtgactccaaaggcaaagtcaccatcactgccggcagtcgagcattggtactaattacactggtaccaagacaaaaaccaatcagtctaccaaagcctcctcatcgagtctgccttcccagccccagtcgtccgacggggtcccctgtaggttcagtcggcagtggatcgtagggacngtactttcccacccttcacctatcgagtcggcctaggaacctgaagatgctagacaactattaacttactagtacaacgaggtaagtagtactcctcccacctacaccgttacgtttcgggacccgaaggggaacccaaggccgtagggaacgtaacgtaaccgaaacgttaccgttggtcgggtacctccgacctaccttacttccgttcgttc

SEQ ID NO: 306288 - DNA, 562 bp, Homo sapiens
  misc_feature: GZ8MTXP01B2O0M.25.39.D06.1.454.CMB.2.raw
  modified_base (150)..(150): a, c, t, g, unknown or other
  misc_feature (150)..(150): n is a, c, g, or t
  modified_base (283)..(283): a, c, t, g, unknown or other
  misc_feature (283)..(283): n is a, c, g, or t
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
tcagactgtacagtcacgaccggtgctcgatttagtgacatctcgcagttctttggggggcatgagcaaaaactgacaagtcaaggcaggaagatgttgccatcacaactcattgggttctgctgctctgggttccagcctccaggggtnaaattatgctgactcagtctccagtactttcagtctgtgactaccaaaggcgaaagtcaccatcacctgccggcagtcgagcattgtactaattacactggaccagacaaaaacaatcagtcacaaagctccnatcgatctgccttcccagcccatcgcgacggggtcccctgaggttcagtcggcagtgatctagggangtacttccaccctcactatcgagtcgcctaggaacctgaacntgctgacaanattactactgtacaaacgaggtagtacgtcgcctaccctacctacgtaaccttcggtttacgggacccgaacgggggaacccaaggttccgagggaacgtaaacttaacgaaaaccggttacttcgggtaagcctgactaccttatcgttaacgtttccc

SEQ ID NO: 306289 - DNA, 625 bp, Homo sapiens
  misc_feature: GZ8MTXP01D2QKB.25.39.D06.1.454.CMB.2.raw
  modified_base (290)..(290): a, c, t, g, unknown or other
  misc_feature (290)..(290): n is a, c, g, or t
  modified_base (375)..(375): a, c, t, g, unknown or other
  misc_feature (375)..(375): n is a, c, g, or t
tcagactgtacagtcacgaccggtgctcgatttagtgacatctcgcagttctttggggggaggaactgctcagttaggacccagagggaaccatggaagccccagctcagcttctcttcctcctgctactctggctcccagattccagcggcgaaactgtgttgacacagtctccagccacctgtctttgtcgtccgggggaacagccacctctcctgcagggccgcagactgttgacaacgacttagcctaggtaccaacagaacgctggccaggctcccaggctcctnatctatgattactccaggtacggccatggcactcccagcccgcttcaggtcggccaggtgggtctaggggacaagtacgtttccnctccaacctattccgtccaaggtccctagacgtcctagaagttattttgacttagttttactactgtacagcctccgacgaaaggaagttcggaccctacaattactttctaccgtttccggccccgttaaggggaacccaaaaggttcggtaaattaacgttaaccgaaaacggtaaacgttggttaggtttcgacccgtaaccttacttcgttcgttcctttacctaacgtttccccttaacccccgg

SEQ ID NO: 306290 - DNA, 603 bp, Homo sapiens
  misc_feature: GZ8MTXP01AL1W6.25.39.D06.1.454.CMB.2.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
tcagactgtacagtcacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaaaaggtgtccactgtcaggtgcacctggtggagtcgtgggggagcgtggtccagccgtgggagtccctgagctctctgtgagcctntggtatttagttcagtggttcnggcatgcacgtgggtccncaggctcgaggcgaagggggccgagtggtggctagttangcacntgatggaattcagaatatatgacagtactcggtagaacgggcctaattccactattccaccagacactaacgttaccccggaatagtttcggtaggttaacgttagggaaaattcgggtactaacgtccgtttaaggacggttccggaagggtaccttccgggcttaacgtaggttacttacgttggtaggaccggttaggttcggttcgggggtaagttgggtaagttaggttacgttacccggggtcgttcgtaag

SEQ ID NO: 306291 - DNA, 516 bp, Homo sapiens
  misc_feature: GZ8MTXP01B6602.25.39.D06.1.454.CMB.2.raw
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
tcagactgtacagtcacgaccggtgctcgatttagtgacatctcgcagttctttggggggcatgagcaaaactgacaagtcaaggcaggaagatgttgccatcacaactcattgggttctgctgctctgggttccagcctccaggggtgaaattatgctgactcagtctccagtactttcagtctgtgactccaaaggcgaaagtcaccatcacctgccggccagtcgagcattggtactaatttcactggtaccagacaaaaaccaatcagtctccaaagctcctnatcgagtctgcttcccagccccatgtcacgggggtcccctgaggttcagtcgcagtggatcgtagggacngactttccaccctnaccatcagtgctggactgagatgctgcaacatattactgtacaacagagtagtgcctcccactcactcgtttcgccgtaggggaacccaagcgtgggaagactacgaacgttcgttcggtcgcgtcgccacttacttcgttcgtc

SEQ ID NO: 306292 - DNA, 733 bp, Homo sapiens
  misc_feature: GZ8MTXP01AFCDM.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacagccacctctcctgcgacgggccgcagactgttgacaacgacttagcctaggtaccaacagaacgcctaggccagggcctcccgaggcctcctcatctatgactacttccgaggtacggccacgtcggcactccccgacgccccgcttcgaggtcggccctaggttggggtccgtgggggacctaaaggttacgttttaacctctacccaacctacttcctacccacgtccctaagacgtaccctaggtaaacgttattttcgacttaagttttaacttacgttcggtactaacggtccttaccggaacgtaaacggtaacggttccggtaccccttaacctaaacgtttaactttcccgttaacccggtttttacccgggccccggttaacggggtaaaaccccgtaaaagggttcgggtaaacttaacgtaaacccgaaaaacggttaaccgtgggttacgggccttacggaaccctaaaccgtctttccggttacgtttccctttaacgttaaccgttttcccccg

SEQ ID NO: 306293 - DNA, 612 bp, Homo sapiens
  misc_feature: GZ8MTXP01C5ZCS.25.39.D06.1.454.CMB.2.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
tcagactgtacagtcacgaccggtgctcgatttagtgacatctcgcagttctttggggggaggaactgctcagttaggacccagagggaaccatggaagccccagctcagcttctcttcctcctgctactctggctcccagattccagcggcgaaactgtgttgacacagtctcagccaccctgtctttgctccgggggaacagccaccctctcctgcagggccgcagactgttgacaacgacttagcctaggtaccaanagaagctggccaggctcccagctcncaatcgtatgatactccagtacggccagtggcactcccagcccgnttcgagtcgcccaggtggtcctaggggacctaagtacgtttaacccnctacacctactccacacgtaccgagacgtactagtaattgtttacgacgtttatttactacgtcgtacgtacgtctaccgaaggtaacggtacgtccgtacctactaattactaccgttaccgttccgtacccgtacggtaaacctaaaggtaacgtaattaaccgtaaacgaaacgtacgttggttacgcttacgaactacctgttcctacgttacttaaccgttccgttcccg

SEQ ID NO: 306294 - DNA, 520 bp, Homo sapiens
  misc_feature: GZ8MTXP01AFLW8.25.39.D06.1.454.CMB.2.raw
  modified_base (261)..(261): a, c, t, g, unknown or other
  misc_feature (261)..(261): n is a, c, g, or t
  modified_base (370)..(370): a, c, t, g, unknown or other
  misc_feature (370)..(370): n is a, c, g, or t
  modified_base (452)..(452): a, c, t, g, unknown or other
  misc_feature (452)..(452): n is a, c, g, or t
  modified_base (504)..(504): a, c, t, g, unknown or other
  misc_feature (504)..(504): n is a, c, g, or t
  modified_base (514)..(514): a, c, t, g, unknown or other
  misc_feature (514)..(514): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcctccggggaacagccaccctctcctgcagggccgccagactgttgacaacgacttagcctggtaccaanagaagcctggccaggcctcccaggctcctcatctatgatacttcagtaggccactggcatccccagccccgcttcagtggccaggtgggtctggggacaagtagtttcnctcaccatcctccagcctagacgtcctagaacgtattttgactagttttattactgtcagctcgacaagagtcgctaccatntctatttccgccgtaggaccaagtgattatacaaacgactgcgcttcgcacntctgttctcncttccc

SEQ ID NO: 306295 - DNA, 699 bp, Homo sapiens
  misc_feature: GZ8MTXP01DAUTS.25.39.D06.1.454.CMB.2.raw
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtctccgggggaacagccaccctctcctgcagggccggccagactgttgacaacgacttagcctggtaccaanagaagcctggccaggctcccaggcctcctcatctatgatacttccagtaggccatggcactcccagcccgtattcagtcggccaggtgggtctggggacctaaggtacgtttttaacccnctacctaacctactccctacgacgtacctagtacgtacgtagtaagttagttttacgactttaagttttaacttacgttcgtacgtacgtaccgttaccgaacgggtaaacggtaacggttaccgtaaccccttaaccgttaacgtttaccgtttacccgtttaacccgtttacccggtaacccggttaacgggtaaacccgtaaaggttaacggtaacttaaacgtaaaccgaaaacggttacgttggttacgttcgttaccgaaccctaaccgttcttaccgttccgtttacctttaaccgttcccgtttcccg

SEQ ID NO: 306296 - DNA, 557 bp, Homo sapiens
  misc_feature: GZ8MTXP01D8VBE.25.39.D06.1.454.CMB.2.raw
  modified_base (150)..(150): a, c, t, g, unknown or other
  misc_feature (150)..(150): n is a, c, g, or t
  modified_base (292)..(292): a, c, t, g, unknown or other
  misc_feature (292)..(292): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctcgaggggtnaaattatgctgactcagtctccagtactttcagtctgtgactaccaaaggcgaaagtcaccatcacctgccggcctgtcgagctagttggtactaatttacactggtaccagaacaaaaacaatcagtctacaaagctcctnatcgagtctcgccttcccagcccatcgtcgacggggtccctgagttcagtcgcagtgatcgtaggacngtacttccaccctcaccatcagtcgcctaggaactgaanatgctagacaatatattactgtacaaagagtagtacgtcgcctcctacctactacgttacgtttacggcccgaaggggaacccaagcgtaggacaacgtaacgaaaaccgttgttacggtgggccttaacggacctacgactttccgttaagtttccc

SEQ ID NO: 306297 - DNA, 607 bp, Homo sapiens
  misc_feature: GZ8MTXP01AZR4G.25.39.D06.1.454.CMB.2.raw
  modified_base (284)..(284): a, c, t, g, unknown or other
  misc_feature (284)..(284): n is a, c, g, or t
  modified_base (593)..(593): a, c, t, g, unknown or other
  misc_feature (593)..(593): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtgaaattatgctgactcagtctccagtactttcagtctgtgactaccaaaggcgaaagtcaccatcacctgccggccagtcggagctattggtactaattacactgacagacaaaacatcatcacaagctcctanatcgagtctcgccttcccagcccctagtcggtccgacgggggttcccctggtaggttcaggtcggcaggtggatcgtagggactgtactttcccacccctcaccctatcgaggtcggccgtaggaacctgaaacgatcgctagaccaaatattaacttactagtacaaacgtagtaagtacgtcgcctaccctaccttacaaccgttcgttttacgggcccggaaacgggggaaccctaaaggccggtaagggacgtaaacgtaacccgaaaacggttcgttgggttaacgcgttaaccgcaacccttntccgttcgtaaccc

SEQ ID NO: 306298 - DNA, 504 bp, Homo sapiens
  misc_feature: GZ8MTXP01ESP9O.25.39.D06.1.454.CMB.2.raw
  modified_base (150)..(150): a, c, t, g, unknown or other
  misc_feature (150)..(150): n is a, c, g, or t
  modified_base (285)..(285): a, c, t, g, unknown or other
  misc_feature (285)..(285): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcaaatcaccatcacctgccggcagtcgagcattggtactaattacactggtaccagacaaaaaccaatcagtctaccaaagctcctnatcgagtctgccttcccagcccatcgtcgacggggtcccctgagttcagtcgcagtgatcgtagggacngtatttcaccctnaccatcagtcgctaggactgaagatgctgccaaantagtactgtacaangatagtcnctcccactacgactacgtttcggaccgaggggaacctaagcgagagactacgaaagcngtgactgcaccttntcgttgtc

SEQ ID NO: 306299 - DNA, 550 bp, Homo sapiens
  misc_feature: GZ8MTXP01BRFIU.25.39.D06.1.454.CMB.2.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtgaaattatgctgactcagtctccagtacttttcagtctgtgactccaaaggcgaaagtcaccatcacctgccggccagtcggagctagttggtactaatttacacgtggtaccagacaaaaaccaatcagtcacaaanctcctnatcgatctcgccttcccagcccatcgtcgacgggtcccctgtacggttcagtcggcaggtggactcgtgggactgtactttccgaccctcacatcagcgctagaaccngaagatgctgacaactatattacngtacaacgtaggatacgtcncctccacttccatccgtttagggcccgaaggggaaccaaggcgtaagggaaagtaacgtaacgaaacgttgttcgtggactcgactaccttagttcgttcgtcc

SEQ ID NO: 306300 - DNA, 696 bp, Homo sapiens
  misc_feature: GZ8MTXP01AFRP5.25.39.D06.1.454.CMB.2.raw
  modified_base (265)..(265): a, c, t, g, unknown or other
  misc_feature (265)..(265): n is a, c, g, or t
tcagactgtacagtcacgaccggtgctcgatttagtgacatctcgcagttctttggggggaggaactgctcagttaggacccagagggaaccatggaagccccagctcagcttctcttcctcctgctactctggctcccagattccagcggcgaaactgtgttgacacagtctccagccaccctgtcttgtcgtccgggggaacagccaccctctcctgcgacgggccgccagactgttgacacgacttacgcctaggtaccaanagaacgcctggccaggcctcccaggcctcctcatcctatgactaccgttccaggtacggccagtcggcactcccacgccctcttcgaggtcggctagggtggtcgtgggactaagtacgtttcctctaccacctacgtcctaccgacgtaccctagacgtacccgttagtaaagttagttttacgtaccgttagtttttaatttaaccgttcggtttaccgaacggtcccgttaaccccggaaggtaaacggttacggttaccggtacccttaaccgttaaatttaccgtttacccgttaacgttttccccgggacccggttacgggaaacccgtaaggtaacggtaacttaacgtaaccgaaaacgtacggtaacggttcggttcttacggaaccactaactcgttcttccttcgttaaccgtttccccg

SEQ ID NO: 306301 - DNA, 589 bp, Homo sapiens
  misc_feature: GZ8MTXP01BW529.25.39.D06.1.454.CMB.2.raw
  modified_base (277)..(277): a, c, t, g, unknown or other
  misc_feature (277)..(277): n is a, c, g, or t
tcagactgtacagtcacgaccggtgctcgatttagtgacatctcgcagttctttggggagctgtgggcttaggaagcagagcctggggcatctccaccatggcctggacccctctcctcctccagcttctcaccctctgctcagggtcctgggcacagtctgcgctgacccaggaagactcggtgtcggggaccgtgggacagaaagtcaccctgtcttgttctggtacgagcgaacaacattggaacgtatcctggtgggctggtaccaacagaanggtcacggtcccccaaaatgtcgatgtctggagatgttcccgccctcgacggggactccccgtgccccgtcttctcgtggggtcacggtgtcgtggggaccctacaacgccctcccgtgacctatccggcgggccctcacgccctggacggacgaggctcggtactacgtgctcgagcagtcgggactctgacgctcgctcgctcgcggtccgtacggggccgggggtcccgttcggacccgttcgacggttcgacggcccgagggttccttccgcccccgtggtccactccttccgttccccgccgttccc

SEQ ID NO: 306302 - DNA, 551 bp, Homo sapiens
  misc_feature: GZ8MTXP01A4TB8.25.39.D06.1.454.CMB.2.raw
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (537)..(537): a, c, t, g, unknown or other
  misc_feature (537)..(537): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttcctgttgttattttccaggtgtccagagtgaggtgcagttggtggagtcgtgggggagcttggtccagcctgggagggtccgtgagagtctcctgtgcagcctctggattcatctcagtcgaccactacatggactggggtcccgcaggctccgagggggaggggctggagtgggtgcgtatagaaataagctaagagttacncanagaactacgcgcgtctagtagaaaggcaagtattcattanctacaagagatgaattacaaaggtactnactgtaatctagactaaaatcgaaacagacctaaggaaaacccgtggaccacgggcgtagtacttacgttgttacgcgtaggtcacggacttacgggtnttaaccgttaaccc

SEQ ID NO: 306303 - DNA, 644 bp, Homo sapiens
  misc_feature: GZ8MTXP01CL59H.25.39.D06.1.454.CMB.2.raw
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (392)..(392): a, c, t, g, unknown or other
  misc_feature (392)..(392): n is a, c, g, or t
  modified_base (614)..(614): a, c, t, g, unknown or other
  misc_feature (614)..(614): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgtcgtccgggggaacagccaccctctcctgcagggccgccagactgttgacaacgacttagcctaggtacccaanagaacgcctggccaggctcccaggcctcctnatctatgactacttccgagtcgggccagtcggctactcccacgcccgtcttacgngtcggccctagggtcggtcgtggggactaacggttagtttccnctaccacctactcctaccgagaccttagacgtcctagtagtattttcgacttagtttactacgtgtacacgtcctaccgtacggaacggtagtcggtaccctactaacttacgttacctaaccgtttccgggaccccgtaagggaaaccctaaaggtcggtaacttacgttaaacgaaaccgggtaaacttgggttacgggttcttcggtaaccctaacgtnttccggtcttaccttcttaacgtttccccg

SEQ ID NO: 306304 - DNA, 609 bp, Homo sapiens
  misc_feature: GZ8MTXP01DZC7B.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtcttgtcgtccgggggaacagccacctctcctgcagggccgccagactgtgacaacgacttagcctaggtaccaacagaacgcctggccaggcctcccgaggcctcctcatctatgatacttccagtacggccagtggcactcccacgcccgtcttcgagtcggccaggtgggtctggggaccaagggtactttaactctaccacctatcctaccagtccctagacgtcctagaagttattttgacttagtttattactgtacagtctacccgagaaagtagtcgacctactaattcttacctacgtttccggcccttaggggaaccctaaaggtggtaattaacggtaaccttaaaacgtaccgttggttgggttcacctaacctacttcgttcgttccttactaacgtttcccgtttccccg

SEQ ID NO: 306305 - DNA, 684 bp, Homo sapiens
  misc_feature: GZ8MTXP01AJ4S7.25.39.D06.1.454.CMB.2.raw
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
  modified_base (394)..(394): a, c, t, g, unknown or other
  misc_feature (394)..(394): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacacgccaccctctcctgcagggccgcagactgtgacaacgacttagcctggtaccaanagaacgcctggccaggcctcccgaggcctccncatctatgatacttccagtacgggccacgtggcactcccgagccccgtcttcgaggttcggcccagggttgggtcgtaggggactaaggtacgttttaacnctacctacctatccctaccgaacgtcccttaaggacgaccgttaggaaagttagttttacggtactttaaggttttacttaaccgttttttcggacctaacgtccgtttacccggaacggtaaacgggtaaacgtacgggtaccccttacctaaacgttactttaccgtaaccgtttccggtacccggttacgggaacccgtaaaggtaaggtaacttaataccgaaacgtaaacgtggttcgggttcttcggtaaccactaacgttctacgttccttcttcgtttcccg

SEQ ID NO: 306306 - DNA, 629 bp, Homo sapiens
  misc_feature: GZ8MTXP01BVIRZ.25.39.D06.1.454.CMB.2.raw
  modified_base (597)..(597): a, c, t, g, unknown or other
  misc_feature (597)..(597): n is a, c, g, or t
  modified_base (619)..(619): a, c, t, g, unknown or other
  misc_feature (619)..(619): n is a, c, g, or t
tcagactgtacagtcacgaccggtgctcgatttagtgacatctcgcagttctttggggagctgtgggcttaggaagcagagcctggggcatctccaccatggcctggacccctctcctcctccagcttctcaccctctgctcagggtcctggacacagtctgcgctgacccaggaagactcggtgtcggggaccgtggacagaaagtcaccctgtcttgttctggtacgagcgaacaaacagttggaacgttatccgtggtcgggctggtaccaacagaatggtcaccggtaccccccaaaatgtgatgtctggagatgtcccgccctcgagggctccccgtggccccgtctttccgtcgtggggtcaggttgtcgtggggacccacgaacgccctcccgtgtactacgtccggccgggccctccgacgcccgtaggacggacgaggcctcggtactactgctcgagtcagtcgggactcgtggagcctcgcctgcctacgtacggtccgttcgggggccggggggttacccgttcggaacccgttccggtacggttccgacggccccgaggttccttcccggcccccgtaggtccnccttccgttccgttaacccccnccgttccccg

SEQ ID NO: 306307 - DNA, 684 bp, Homo sapiens
  misc_feature: GZ8MTXP01AI07Z.25.39.D06.1.454.CMB.2.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (402)..(402): a, c, t, g, unknown or other
  misc_feature (402)..(402): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccggggaacngccaccctctcctgcagggccgccagactgttgacaacgacttagcctggtaccaanagaagccnggccaggcctcccaggctcctcatctatgactacttccgaggtaggcccagtcggccactccccaggtccccgtctttcaggttcggcccgtaggttcggggtctagggggacctaaaggttaccggttttaacnccttaccaaccctacttcctccgacgtacccttaggaccgtcccttaggaaacgttattttggaccttaagttttacttaactcggttacaacgggtccttacccggaaggtaaacggtaacggttccggacccctttaaccaaagttacctttccgtaacgtttccgggaccctaggggtaaacccaaaggttaacggattaacgaccgttaaaacgtacgtgggttaggttcgaccttaacctacgtcttgtcctttacctaacgtttcccgtaaccccg

SEQ ID NO: 306308 - DNA, 758 bp, Homo sapiens
  misc_feature: GZ8MTXP01E3VGE.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtcgtccgggggaacagcccaccctctcctgcgacgggccggccagactgttagacaacgtacttacgcctaggtaaccaacagaacgcctggccaggcctcccgaggcctcctacatcctatgtactaccttcgaaggtacgggccacgtggccaacgtcccacggccccgtctttcgaggttcggcccctaggggttcggggtctagggggacctaagggttacgtttaacctcctactaaccctagttccctaccgaacgtaccccttaagggacctaccgtaaggtaaacgtttagttttacggtacctttaagggtttttaacgtttaaccctggttacctaaacggttcctaaccccgggtaaaacggtaaacgggtaaccggttccggtaccccttaaaccgttaaacgtttaccgtttacccgttacccgggtttacccggtaacccggtaaacgggtaaacctaaagggtaacgtaacttaaacgtaaaccgttaaacgtacgtggttacgcgttacgtaacctactaacgttctccgttacttcgttaaccctcccgg

SEQ ID NO: 306309 - DNA, 595 bp, Homo sapiens
  misc_feature: GZ8MTXP01DFPTL.25.39.D06.1.454.CMB.2.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (565)..(565): a, c, t, g, unknown or other
  misc_feature (565)..(565): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccggggaacngccaccctctcctgcgagggccgccagactgttgaacaacgacttagcctggtaaccaacagaagcctggcccaggcctcccaggcctcctnatctangatacttccagtacggccactggcagtcccagcccgcttgacgtgcccaggtggtcnggacaagtacgtttcnctcacctatcctacgntaccctagactcctaggaattagtttcgacttagtttactaacgtgttacagcgttccgacgtaaagacgttcgcctacatacttcgaaccgtttccgccgtacggtaaccgaaagtggaacttataaaccgaacgtaaaccgtgttacggcttacggaaccctaaacgtctttcncgggttcctttaacgttaacgtttcccccg

SEQ ID NO: 306310 - DNA, 629 bp, Homo sapiens
  misc_feature: GZ8MTXP01C8J0Y.25.39.D06.1.454.CMB.2.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtcttgctccgggggaacngccaccctctccngcagggccgccagactgttagacaacgacttagcctaggtacccaacagaacgcctggacccagggcctcccgaggcctacctcatctatgatacttcagtacggccatggcatcccagcccgtntcagtcggcaggtggtctggggacaaggtagtttcnctaccaacctatctaccagccctagacgcctagtaagtattttgacttagtttatacgtgtacagtaccgttaccgacgtaagacgttcggacccttaccaacttacgttacctaaccgtttcggacccgttaggggaaccctaaaggtcggaacttaacgttaaacgaaaaccgtaaccgttggttaccggacttaccggaaccctaaaccgtaactttcggtacttttccttaaccgttaacgtttcccccg

SEQ ID NO: 306311 - DNA, 567 bp, Homo sapiens
  misc_feature: GZ8MTXP01CIH1Z.25.39.D06.1.454.CMB.2.raw
  modified_base (315)..(315): a, c, t, g, unknown or other
  misc_feature (315)..(315): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (557)..(557): a, c, t, g, unknown or other
  misc_feature (557)..(557): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagcttgggttttccttgttgtttatttttccaggtgtccagagtgaggtgcagttggtggagtcgtgggggagcgttggtccagccgtggagggtccgtgagagtctcctgtgcagcctctggattcattcttcagtcgaccactacatggactgggtcccnccgaggcctccgagggggaagggctgggagttgggtgacgtaattagaaataagctaagaagttacncanagaactacgccgngtcngtagaaaggcagtattcattatctagaagtagatagattacaaaggtacttacgactagttaatctagacaaatgaaaccagtacctaaggaaaaccgaggacacggttccgtagttaagttacgttgttagcgtaggcagtacgttacgggtcnccgttaaccc

SEQ ID NO: 306312 - DNA, 610 bp, Homo sapiens
  misc_feature: GZ8MTXP01BXCRU.25.39.D06.1.454.CMB.2.raw
  modified_base (396)..(396): a, c, t, g, unknown or other
  misc_feature (396)..(396): n is a, c, g, or t
  modified_base (591)..(591): a, c, t, g, unknown or other
  misc_feature (591)..(591): n is a, c, g, or t
tcagactgtacagtcacgaccggtgctcgatttagtgacatctcgcagttctttggggggaggaactgctcagttaggacccagagggaaccatggaagccccagctcagcttctcttcctcctgctactctggctcccagattccagcggcgaaactgtgttgacacagtctccagcccaccctgtctttgtccgtccgggggaacagcccaccctctcctgcacgggccgccagactgttagacaacgacttagcctggtaaccaacagaacgcctggccaggcctcccgaggcctcctcatctatgatacttcagtacgggccacgtggcactcccacgcccgtcttcgagtcggccgagggtgggtcgtaggggactaagtacgtttaaccncttaccacctactcctaccgacgcctagacgcctaggaagttatttgactttagtttattactggtacagtcctaccgagtaaaggacggtcgtacctacgtaattcttctaacgtttcccggaccgtacggaaccctaaaggtcggtaattaacgtaaccaaacgtacgtgcggcttcggaaccactaatcgtnttccttcttaacttccccg

SEQ ID NO: 306313 - DNA, 638 bp, Homo sapiens
  misc_feature: GZ8MTXP01CCSYV.25.39.D06.1.454.CMB.2.raw
  modified_base (180)..(180): a, c, t, g, unknown or other
  misc_feature (180)..(180): n is a, c, g, or t
  modified_base (306)..(306): a, c, t, g, unknown or other
  misc_feature (306)..(306): n is a, c, g, or t
  modified_base (600)..(600): a, c, t, g, unknown or other
  misc_feature (600)..(600): n is a, c, g, or t
  modified_base (632)..(632): a, c, t, g, unknown or other
  misc_feature (632)..(632): n is a, c, g, or t
tcagactgtacagtcacgaccggtgctcgatttagtgacatctcgcagttctttggggctgggagaggagcccagcactagaagtcggcggtgtttccattcggtgatcagcactgaacacagaggactcaccatggagtttgggctgagcttgggttttcctcgttgcttcttttaagnggtgtccactgtcaggtgcaccgtggtggagtcgtgggggagcgtggtccagccgtgggacgtcctgagctctcctgtgagtcctgtggtatttagtcagtgttctggcatgctacgtcgggtccnccagggcctccgagggtcgaaggggggcccgaggttgggttcggctaaggttatagccccaatagttggaagttgggggaaaaactttcgtaaggtaaatttaagttaactaacgaggtaacccgtccggtagggaaacggggccctaattccaacctatccctacgaagacgaacctaacgttaccccggaatagttcgtaggttacttaaggaaattgggtacagccgtagacgagtcgaggtacctcgggcttcgttagtacttacgtgtcgacgttaggacgttgggggnggttgggtagtcggttacgttaacccgggggngtaacg

SEQ ID NO: 306314 - DNA, 612 bp, Homo sapiens
  misc_feature: GZ8MTXP01B45WW.25.39.D06.1.454.CMB.2.raw
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
  modified_base (443)..(443): a, c, t, g, unknown or other
  misc_feature (443)..(443): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtccgtccgggggaacagccaccctctcctgcagggccgccagactgttgacaacgacttagcctggtaccaacgagaagcctggccaggcctccaggcctctcatctatgatctccagtacggccatggcatcccagccccncttcagtcggccaggtggctgggactaaggtatttcnctcaccagtcctacagccctagngcctagaagtattttgacttagtttattacgtgttacagtcttacccgganaaacggtaaggtcggtaccctactaaacttacgttactaccgttttccggaccccgttaggggaaacccctaaaggtcggtaaattaacttaacccgaaaacgtaaaccgttggttaccgggcgttacgtaacctacctaacttcttcgttccttccgttccgttcccg

SEQ ID NO: 306315 - DNA, 602 bp, Homo sapiens
  misc_feature: GZ8MTXP01ABZRU.25.39.D06.1.454.CMB.2.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtcttgctccggggaacngccacctcncctgcagggccgcagactgtgacaacgcttagcctggtaccaacagaagcctggccaggctcccaggctcctcatctatgatacttccagtaggccaactagcactcccagccccgtntcgngtcgccnggtggtcgnggactaagtacgtttcnctaccacctactccncagtaccctagacgtcctagtaagtntttacgacgttagtttactacgtcgtacgacgtcgtaccgacggtaaacggtacggtccggtacccttaacgtaaattacttaccgtaccgtttccggacccgtacgggaacctaaaggtaacgaattaacgtaacgaaacgtacgtcggttacgccttacgaaccacgtaattctacgttccttaacttcgtcccg

SEQ ID NO: 306316 - DNA, 557 bp, Homo sapiens
  misc_feature: GZ8MTXP01A00OS.25.39.D06.1.454.CMB.2.raw
  modified_base (288)..(289): a, c, t, g, unknown or other
  misc_feature (288)..(289): n is a, c, g, or t
  modified_base (379)..(379): a, c, t, g, unknown or other
  misc_feature (379)..(379): n is a, c, g, or t
  modified_base (416)..(416): a, c, t, g, unknown or other
  misc_feature (416)..(416): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcgagggccgcagactgttgacaacgacttagcctggtaccaacagaagctggccaggctcccaggctccnntctatgatacttccagtacggccatggcactcccacgccccgtcttacgagtggcccagggtggggtctggggacaagttacgtttaacnctccacctatcctcccagtccctagcgcctagaagtntttgactagtttatactgcagtctcgacgaagagtcgcctacatactctacttccgcctggaccaagtgattacgtacaaacgaactggttacgcgttcaactaccctaagttccctggttccttccttaaggtttccccc

SEQ ID NO: 306317 - DNA, 748 bp, Homo sapiens
  misc_feature: GZ8MTXP01D4T1G.25.39.D06.1.454.CMB.2.raw
  modified_base (397)..(397): a, c, t, g, unknown or other
  misc_feature (397)..(397): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtcgtccgggggaacagccaccctctcctgcaggccggcagactgtgacaacgacttagcctaggtaccaacagaacgccgtcggccacggcctcccaggcctcctcatctatgatacttccgaggtacggaccacgtcggcacgtcccgacgcccgtcttcgagtcggccaggtgggtcgtacgggactaaagttacgtttaaccncttaccaaccctaacttcccgtaccgacgtaccccttaacggacgtcccgttaaggtaaagtttacgttttacgaccgtttaagtttttaattaaccgttcgttacgaacgtccgttacccgaacggggtaaaacggtacggttaccggtaccccttaacctaaacgttaacctttaccgtaaacccgttttcccgggaaccccgggttaaggggtaaaccccgtaaaagggtaacgggtaaacttaaacgtaaaccgttaaaaaccgtacgttacggttacggttcgttaccggaacccaaccgttaacttccggttacttcctttaaccgttaaccgttttaacccccg

SEQ ID NO: 306318 - DNA, 593 bp, Homo sapiens
  misc_feature: GZ8MTXP01DO49N.25.39.D06.1.454.CMB.2.raw
  modified_base (381)..(381): a, c, t, g, unknown or other
  misc_feature (381)..(381): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggggaacagccaccctctcctgcagggccgccagactgttgacaacgacttagcctaggtaccaacagaacgcctggcccaggcctcccaggcctcctcatctatgatacttccagtacggccatggcactcccagcccgtcttcgagtggccaggtgggtctggggacaaggtagtttaacnctcaccatcctacagccctagacgcctagaagtatttgactagtttatactgtcagtctccgagaaagtaagttcgaccttaccaaattcttaccgtacgtttccggacccgttaggggaaccctaaaggtcggaattaacgtaccgaaaacgtaacgtggttcggcttcggaacctaaacctcttcttcgttaccttcttaaccgttcccg

SEQ ID NO: 306319 - DNA, 669 bp, Homo sapiens
  misc_feature: GZ8MTXP01AL2CF.25.39.D06.1.454.CMB.2.raw
  modified_base (202)..(202): a, c, t, g, unknown or other
  misc_feature (202)..(202): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtcttgtcgtccggggaacngccaccctctcctgcagggccgccagactgttagacacgacttagcctggtaccaacagaacgcctggcccaggcctcccgaggtcctcctacatctatgataccgtccagtacggccacgtggcactcccacgcccgtcttcgagtcggcctaggtgggtcgtgggacaagtacgtttctctcacctactcctaccgacgtccctagcgaccgttagaaagttgttttgactttaggttttacttacgtcgttccagtcccgttaccggaacgtaaacggtacggtaccggtaccccttaacctaagtttactttccggtaaacccgtttttccgggacccgttaacgggaaacccgtaaagggttaacggtaacttaacggtaccgaaaacggtaacgttcggttacgggttccttacggaacctaccgtaacgttctcgttacccttccgttaactttcccccg

SEQ ID NO: 306320 - DNA, 569 bp, Homo sapiens
  misc_feature: GZ8MTXP01DA40R.25.39.D06.1.454.CMB.2.raw
  modified_base (150)..(150): a, c, t, g, unknown or other
  misc_feature (150)..(150): n is a, c, g, or t
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
tcagactgtacagtcacgaccggtgctcgatttagtgacatctcgcagttctttgggggggcatgatcaaaactgacaagtcaaggcaggaagatgttgccatcacaactcattgggttctgctgctctgggttccagcctcgaggggtnaattatgctgactcagtctccagtactttcagttctgtgactaccaaaggcgaaagtcaccatcaccgtgccggcaggtcgagctattgtaacttattacactggtaccagaacaaaaaccatcagtctacaagctcctnatcgatctgcctcccagcccatcggtccgacggggtccctgaggttcaggtcgcagtgatcgtagggcaagtcttccaccctcacntcgagtcgctaggaactggaaacngtgctagaccaaatataattaccttagacaaacgtaggtagttacgtctccctacctaccgtacctacgttaccggtttcggaccggtaacggggaaccaagggctacgggataaacgtaacccgaaaagttcgttaggcggtaatcgaccaccgttcttcgttcgttc

SEQ ID NO: 306321 - DNA, 619 bp, Homo sapiens
  misc_feature: GZ8MTXP01EOCVN.25.39.D06.1.454.CMB.2.raw
  modified_base (216)..(216): a, c, t, g, unknown or other
  misc_feature (216)..(216): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
tcagactgtacagtcacgaccggtgctcgatttagtgacatctcgcagttctttggggctgggagaggagcccagcactagaagtcggcggtgtttccattcggtgatcagcactgaacacagaggactcaccatggagtttgggctgagcgttgggttttcctcgttgcttacttttaaaaggtgtccactgtcaggtgcacgtggtggagtcgngggggaggcgtggtccagccgtgggacgtcctgacgactctctgtgacgctcgtggtatttgttcngtgtctgnangcacgtggccncagctacgaggcgacgggggccgtaggtggtggactagttanagacaacgtagtaggtaagttaggtaaacgtttgtaagtaatttattaacgtcgacgtaacggtaccgtcgggtaaggggaacggtcctaattaccacctatcctacgaagacaaactacgtaccgaattagttcgtaggttacgtaggtaaactggttacacggtccttaaggacgttcggaacggtcgtcggtcctgttagttattacgttggtcgaggttaggcggttaggggtggttaggtaaggtttagtacggttcggcgttgtaagg

SEQ ID NO: 306322 - DNA, 654 bp, Homo sapiens
  misc_feature: GZ8MTXP01E064W.25.39.D06.1.454.CMB.2.raw
  modified_base (152)..(152): a, c, t, g, unknown or other
  misc_feature (152)..(152): n is a, c, g, or t
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
  modified_base (630)..(630): a, c, t, g, unknown or other
  misc_feature (630)..(630): n is a, c, g, or t
tcagactgtacagtcacgaccggtgctcgatttagtgacatctcgcagttctttgggggggcatgagcaaaaactgacaagtcaaggcaggaagatgttgccatcacaactcattgggtttctgctgctctgggttccagcctccaggggtnaaattatgctgactcagtctccagtactttcagtctgtgactaccgaaaaggcgaaagtccaccatccacctcggccggcaggtcgagctagttaggtaacttaatttacactcggtaaccaagaaccaaaaaaccaatcacgtacctaccaaacgtcctcctacacgtcgtagttcctcgcccttccccgacgcccctagtcggtccgtaccgggggttcccctggtacggttcgaggtccggcaggtggtacncggtagggactaactacttacccaccctcacctntacgcggttcgacgtacggaaacctagaacgagtcgacgtanaccaaatnttaacgttacncgtaacaacaagtagtacggtctacccctccaaccgttctaaccgttcgtttaccgggaccgaaacgggggtcccaaggttcgacgggaacttaaacgtaacccaaaaccgttgttcggtcggactcnctacccttattcttaacgtttccc

SEQ ID NO: 306323 - DNA, 626 bp, Homo sapiens
  misc_feature: GZ8MTXP01B4QLJ.25.39.D06.1.454.CMB.2.raw
  modified_base (416)..(416): a, c, t, g, unknown or other
  misc_feature (416)..(416): n is a, c, g, or t
  modified_base (606)..(606): a, c, t, g, unknown or other
  misc_feature (606)..(606): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtcgtccgggggaacgagcccaccctctcctgcgagggccgccagactgttgacaacgacttagcctaggtaaccaaacagaacgcctggcccaggcctcccgaggcctcctcatctatgataccttccgaggtacgggccacgtggccactccccgacgtccccgtcttcgaggtcggccctaggggttggggtcctgggggaacctaaagggttacgttttccncctaccgaccctatccctccgagtccctagacgtacctaggtaaagttattttgacttagttttaacttacgtgtacgacgtctaccgacgaaacggtagtccggtaccctacaagttcttccgtacgtttccggcccgtaggtaaccaagtgaattacgacaaacgtacgtggttcggcttgccacgtntctgttccttcttcgttccc

SEQ ID NO: 306324 - DNA, 700 bp, Homo sapiens
  misc_feature: GZ8MTXP01EOU28.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgtcgtccggggaacgagccaccctctcctgcagggccgcagactgttgacaacgacttagcctggtaccaacagaagcctgccaggctccaggctcctcatctatgatactccagtacggccaactggacactcccagccctcttcgagtcgccaggtggtcgtagggacaagtacgtttaactctacacctactcctaccgacgtcccttagacgtccgtagaaagtagttttgtacgtaagtttttaactaccgttaggttaccaaacgggtccttacccggtaacggaaaacggtaaaacgggttccgggtaacccttaacctaaacgtttaccttaccgtttaaacccgtttcccgggtaccccgttacgggggtaaacccctaaaagggtcggtaaattaaacgtaacccgttaaaaaggtaaacccgtttggaacgggttcttaccgaacctaaccccgtaaattccccggtttacgttaccctttaacccgttaaccgttccccg

SEQ ID NO: 306325 - DNA, 643 bp, Homo sapiens
  misc_feature: GZ8MTXP01D0QVX.25.39.D06.1.454.CMB.2.raw
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgtttattttccaggtgtccagagtgaggtgctaggttggtggagtcggtgggggagtcgttggtccagccgtgggagggtccgtgagagtctcctgtgcagcctctggattcattcttcagtcgacctaactacagtcgggactcgggggtccccgaccgaggcctaccggagggggaagggggcgtggggagtggggtggaccgttaagttaagaaaataaagctaaagaagttaaccaacganagaaactacgccgacgtctagtagaaganagatanattatactacaagagatagtaataacgaaaggtaactacgaacttagtaatcgtagtaacaaaagtacgaaacgacgaccgaaacggaaaaaaccggacggaaaccgaccgggttaccgttaggttaacttacgttgttacgaacgtaggtaacgtaagtacgttaacgggtcgttaacccgtttaaccccg

SEQ ID NO: 306326 - DNA, 648 bp, Homo sapiens
  misc_feature: GZ8MTXP01D0ZLD.25.39.D06.1.454.CMB.2.raw
  modified_base (150)..(150): a, c, t, g, unknown or other
  misc_feature (150)..(150): n is a, c, g, or t
  modified_base (156)..(156): a, c, t, g, unknown or other
  misc_feature (156)..(156): n is a, c, g, or t
tcagactgtacagtcacgaccggtgctcgatttagtgacatctcgcagttctttgggggggcatgagcaaaactgacaagtcaaggcaggaagatgttgccatcacaactcattgggttctgctgctctgggttccagcctcgaggggtnaaattntgctgactcagtctccagtactttcagtctgtcgactaccgaaagggcaaagtccaccatccaccgtgccgggcaggtcgagctagttggtaactaatttacacgtggtaccagaacaaaaaaccaatcaagtcctaccaaagcctcctcatcgattctcgccttccccagtcccctagtccgtccgaccgggggttcccctggtggttcgaggtcggactaggtcgtaactcgtaacgggactgtactttccaaccctcaaccatcgagtcgccgtaggacgtgaagatgctagacaactataacgttactagtacaagtaacggtagtaacggtctacctccctacctacctaccgttaccgttttaccgggaccggaacgggggtaaccaacgggttcgtacgggttaacgtaaaccgtaaccgttaaaacggttccgttaggttaacgggcctaacggaccctaccgttacttccgttaacgtttccc

SEQ ID NO: 306327 - DNA, 566 bp, Homo sapiens
  misc_feature: GZ8MTXP02IOFGA.25.39.D06.1.454.CMB.2.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttcctgttgttattttccaggtgtccagagtgaggtgcagttggtggagtctgggggagcttggtccagcctggaggtccgtgagngtctcctgtgcagcctctggattcatcttcagtgaccactacatggactgggtccnccaggctccgagggaaggggctgggagtgggtggccgtagttagaaataaagctaagagttacaccgacagaatacgccgngtctgtagaaaggcagattcattaatcctaanaagagatagtaattacaaataactactacttagtactacgtagactaaataacgaacgaacgacgtaacgaaaacggaaacggaacgacggacgtacgtacgttacgtagtagtaacgtacgtacgtacgtacgtacgtacgtactacc

SEQ ID NO: 306328 - DNA, 535 bp, Homo sapiens
  misc_feature: GZ8MTXP02GRRZO.25.39.D06.1.454.CMB.2.raw
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgccagactgttgacaacgacttagcctggtaccaacagaagcctggccaggctcccaggctcctcatctatgatacttccagtaggccatggcatcccagccccgnttcagtggccagtgggtctgggacagtagtttcnctcaccatcctccagccctagcgcctagaagtattttgactagtttattactgtcagtctccganaagagtcgacctacaatacttctacgttccgccgtaggaaccaagtcgatactaacgaaacgtacgtgtacgctacgccaccgtacttctgtccttctacttcccg

SEQ ID NO: 306329 - DNA, 540 bp, Homo sapiens
  misc_feature: GZ8MTXP02IVXZK.25.39.D06.1.454.CMB.2.raw
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacgagccaccctctcctgcagggccggccagactgttgacaacgacttagcctggtaccaacagaagcctggccaggctcccaggcctcctcatctatgatacttccagtaggccatggcatcccagcccgnttcagtggccagtggtctggggacagtagtttcnctcaccatcctcagccctagagcctgaagtattttgctagtttattactgtcagtctccgacaagtaagtcggcctacctaatacttcactttcggccctagggacccaaaagttcggataataccaaaacgtaactgtacggactgaacaccattcctgttacttcacttccc

SEQ ID NO: 306330 - DNA, 519 bp, Homo sapiens
  misc_feature: GZ8MTXP02JGWUU.25.39.D06.1.454.CMB.2.raw
  modified_base (149)..(149): a, c, t, g, unknown or other
  misc_feature (149)..(149): n is a, c, g, or t
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
  modified_base (489)..(489): a, c, t, g, unknown or other
  misc_feature (489)..(489): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcaaagtcaccatcacctgccggcagtcggancattggactaattacactggtaccagacaaaaccaatcagtctaccaaagctctcatcgatcngctcccagcccatgcagggtcccctgagttcagtcgcagtgatcngggacngatttcaccctnaccatcagtcgcctaggaacctgaacgatgctgacaaactatattacngtacaaacagagtagtgaccttccaccttcactactttcggaccgtaacggggaccaaaggctacgggaaatacgtacaaaaccgtntagtcggactcgaccaccatccgtgttacc

SEQ ID NO: 306331 - DNA, 532 bp, Homo sapiens
  misc_feature: GZ8MTXP02HXAZF.25.39.D06.1.454.CMB.2.raw
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
tcagactgtacagtcacgaccggtgctcgatttagtgacatctcgcagttctttgggggcatgagcaaaactgacaagtcaaggcaggaagatgttgccatcacaactcattgggttctgctgctctgggttccagcctccaggggtgaaattatgctgactcagtctccagactttcagtctgtgactccaaaggcgaaagtcacatcacctgccggcagtcggagcattggtactaattacactggtaccagacaaaaaccaatcagtctaccaaagctcctnatcgagtctgcttccccagccccatgtccgacggggttcccccnggaggttcaggtcggcaggtggatcgtgggacngtacttcaccctcacatcagtgcctggaacctgaaantgctgacaactatattactgtacaaacgtagagtagtcnctcccaacctcactactttggaccctaaggggaccaaggctagggactaactcgaaaacgactggtaacggctcgaccacacttcttacgttcc

SEQ ID NO: 306332 - DNA, 525 bp, Homo sapiens
  misc_feature: GZ8MTXP02IMUMD.25.39.D06.1.454.CMB.2.raw
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (415)..(415): a, c, t, g, unknown or other
  misc_feature (415)..(415): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgtcgtccgggggaacgagccaccctctcctgcagggccggccagactgttgacaacgacttagcctggtaccaacagaagctggccaggctccaggctctcatctatgatacttccagtaggccatggcatcccagccccgctcagtcggccagtgggtctggggacaggatttacnctcaccatcctcagcctagcnctagaatntttctntattattatntnncncacaagagtacgctactactatactacttcgtccgtacggacgaaacgtacgtagtaataacaaacgaaacgtacgtacgtactacgaacgacactctacgtctctactc

SEQ ID NO: 306333 - DNA, 534 bp, Homo sapiens
  misc_feature: GZ8MTXP02HDPCI.25.39.D06.1.454.CMB.2.raw
  modified_base (367)..(367): a, c, t, g, unknown or other
  misc_feature (367)..(367): n is a, c, g, or t
  modified_base (431)..(431): a, c, t, g, unknown or other
  misc_feature (431)..(431): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgttgacaacgacttagcctggtaccaacagaagcctggccaggctcccaggcctcctcatctatgatacttccagtacggccacgtggccatcccagcccgcttcagtgccagtgggtctgggacagagtttcnctcaccatcctcagccctagacgcctagaagtattttgctagtttattactgtcagtctccganaagtaagtcggcctaccaaattacttctacgtttcggccctagggacccaaaaggtcggatatacaaacgaactgtacggctagcaccatctgtctcacttcc

SEQ ID NO: 306334 - DNA, 532 bp, Homo sapiens
  misc_feature: GZ8MTXP02J3RIM.25.39.D06.1.454.CMB.2.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagatttcagcggcgaaactgtgttgacacagtctccagccaccctgtctttgtctccggggaacngccaccctctcctgcagggccggccagactgttgacaacgcttagcctggtaccaacagaagcctggcccaggctccccaggctcctcatctatgatacttcagtaggccactggcatcccagcccgnttcagtgccagtgggtctgggacagagtttccctcacntccncagcctagacgctagaagtatttgacttagtttatactgtacagctcgacaagtagtcgacctactaatacttctacgtttccggccctacgggaacctaagtcggactactacgaaacgtactcgtacgctacgaaccacactcttagtctcactccg

SEQ ID NO: 306335 - DNA, 495 bp, Homo sapiens
  misc_feature: GZ8MTXP02GNQ15.25.39.D06.1.454.CMB.2.raw
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (463)..(463): a, c, t, g, unknown or other
  misc_feature (463)..(463): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggcagtcggagcattggtactaatttacactggtaccagcaaaaaccaatcagtctccaaagctcctcatcgagtctgcttcccagcccatgtcaggggtcccctgaggttcagtcggcagtggatctggggacagntttcaccctnacccatcagtgcctggacctgagatgctgcaacatattactgtacaacagagtagtgctccacctcactactttcggaccagggaccagctgggaanacacgaacgactgtgctcgacacactctcgtc

SEQ ID NO: 306336 - DNA, 520 bp, Homo sapiens
  misc_feature: GZ8MTXP02HAVX0.25.39.D06.1.454.CMB.2.raw
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (394)..(394): a, c, t, g, unknown or other
  misc_feature (394)..(394): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgccagactgtgacaacgacttagcctggtaccaacagaagcctggccaggctcccaggcctcctcatctatgatacttccagtacggccatggcatcccagcccgnttcagtgccagtggtcngggacagagtttcnctcaccatcctccagccctagagcctagaagtnttttgctagtttattactgtcagctccgacaagtaagtgacctacaattacttctacgtttcgccttagggacctaaagtcgatatacgaaacgaactgtacgctagcacatctgtcttcattccc

SEQ ID NO: 306337 - DNA, 608 bp, Homo sapiens
  misc_feature: GZ8MTXP02H4A1O.25.39.D06.1.454.CMB.2.raw
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgtctccggggaacacgccaccctccctcgcacgggccggccacgactgttgtacaacgacttagctcgtacaacagaagcncggcgagctcccacggctccncactctactgatacttcctacgtaggccgactgcgactcccacgccgctcagtggcagtgggtcgtggacgagtagtttactctcacactctcctacgcctagacgcctagtaaagtacttttgcgttaagtttattactgtacacacgttccgacgtaaagaaacgtcggtaccctactaaacttagttcctacgttttcccggaccgttacgggaaccgtaaaagtacggtataacgttacgaaaaccgtaaacgtggttcgggacttacggaccaacctataccgttcgttactttaccgttctacctttccccg

SEQ ID NO: 306338 - DNA, 592 bp, Homo sapiens
  misc_feature: GZ8MTXP02G4ZKE.25.39.D06.1.454.CMB.2.raw
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtctccggggaacagccaccctctcctgcagggccggccagactgttgacaacgacttagcctggtaccaacagaagcctggccaggctcccaggctcctcatctatgatacttccagtaggccatggcatccccanccccgnttcagtgccaggtggtctggggacagtagtttcnctcaccatcctcanccctagngcctagaagtatttgactagtttatactgtacagctcgacaagtaagtcggacctacaaattattcctaactttccggcccgttacggggaaccctaaaaggtcggtaactttaagtaaccaaaacgtaaaccgttggttacggtttacgacctaaccgtaacttaccgtttacgttacctttacctacctttacccgttcccccg

SEQ ID NO: 306339 - DNA, 515 bp, Homo sapiens
  misc_feature: GZ8MTXP02IM1TX.25.39.D06.1.454.CMB.2.raw
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (487)..(487): a, c, t, g, unknown or other
  misc_feature (487)..(487): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggagcttggtccagcctggagggtccgtgagagtctcctgtgcagcctctggattcatcttcagtgaccactacatggactgggtccnccaggctccgaggggagggctggagtgggtgccgtatagaaataagctaagagttacaccacagaatacgccgngtctgtgaaagcagattcattanctanaaganatnatanaaanactnatntatctananaananananacacgaaacgacgacgacgacgtacgtactactgtgngtacgtacgacgacgtacgtacgactac

SEQ ID NO: 306340 - DNA, 497 bp, Homo sapiens
  misc_feature: GZ8MTXP02HB6GZ.25.39.D06.1.454.CMB.2.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgttgctctgggttccagcctccaggggtgaaattatgctgactcagtctccagactttcagtctgtgactccaaaggcaaagtcaccatcacctgccggcagtcggancattggtactaattacactggtaccagacaaaaaccaatcagtctaccaaagctcctcatcgagtctgcctcccagcccatgtcaggggtccccngagttcagtgccagtgatcgtggacagntttcaccctcaccatcagtcgcctggaacctgaagatgctgacaaacatattactagtacaaacagagtagtcgactccacctcactactttggccgagggaccagctggagatacaaacgactgtacgctgacacatctcgtctc

SEQ ID NO: 306341 - DNA, 560 bp, Homo sapiens
  misc_feature: GZ8MTXP02JBQAT.25.39.D06.1.454.CMB.2.raw
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtgaaattatgctgactcagtctccagtactttcagtctgtgactccaaaggcaaagtcaccatcacctgccggcaggtcggagctattggtaacttaattacacgtggtaaccaagaacaaaacaatcatcacaaagctccnatcgatctgcctcccagcccatcgtcgacgggtccccnggtagtcagtgcaggtgatcgaggacngtcttccaccctcaccatccgagtcgccgtagaacctgaagatgcgtanacaatatacttacgtntacaaacgtagagtacgtactacctacccaacctctacttaccgtttacggaccgtaacgggaccgaaggtaccgacggaagaactaaccgaaaacgtacgtggtaacggactacgtaccacgtacttccgtacttacc

SEQ ID NO: 306342 - DNA, 532 bp, Homo sapiens
  misc_feature: GZ8MTXP02J3XXT.25.39.D06.1.454.CMB.2.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaatttacactggtacccagcaaaaaccaatcagtctccaaagctcctcatcgagtctgctcccagccccatgtcaggggtccccngaggttcagtgcagtggatcngggacngatttccaccctnaccatcagtggcctggaaccctgaaacgntgctagacaaactattacttactagtacaacgagtagtacgtcncctacccacctactacgttacgtttacggaccgacgggaccagcgaggacacgtaacgaaacgtacgtggtcgctacgaccacctactctctc

SEQ ID NO: 306343 - DNA, 561 bp, Homo sapiens
  misc_feature: GZ8MTXP02HRY2G.25.39.D06.1.454.CMB.2.raw
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtctccggggaacgagccaccctctcctgcagggccggccagactgtgacaacgacttagcctggtaccaacagaacgcctggccaggctcccaggcctcctcatctatgatacttccagtagggccacgtggcatcccagcccgcttcagtggccaggtgggtctggggacagtagtttcnctcaccatcctccagccctagancctagaaagttntttgcttagtttatactgtacagtctcgacgaagtacgtcgacctactaatacttctacgttcggaccgtacggaaaccgaagtacgtaatacgtaacaaacgtacgtcgttacgtacgacaacgtactcgtcttacttactacttccctcccg

SEQ ID NO: 306344 - DNA, 517 bp, Homo sapiens
  misc_feature: GZ8MTXP02JYQST.25.39.D06.1.454.CMB.2.raw
  modified_base (289)..(289): a, c, t, g, unknown or other
  misc_feature (289)..(289): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcacctgccgggccagtcggagcattggtactaatttacactggtaccagacaaaaaccaatcagtctaccaaagctcctnatcgagtctgcttcccagcccatgtcagggtcccctgagttcagtgcagtgatcgtgggacngatttcaccctnaccatcagtcgctggacctgaanatgctgacaacatattactgtacaacagagtagtgctccacctcactacgtttggaccgaaggggacccaaggccgtacggaagactaccgaaaacgtactaggtcggctcggaccaccatcgtcgtttcc

SEQ ID NO: 306345 - DNA, 527 bp, Homo sapiens
  misc_feature: GZ8MTXP02H9Q2W.25.39.D06.1.454.CMB.2.raw
  modified_base (352)..(352): a, c, t, g, unknown or other
  misc_feature (352)..(352): n is a, c, g, or t
  modified_base (391)..(391): a, c, t, g, unknown or other
  misc_feature (391)..(391): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcacctgccgggccagtcggagcattggtactaattacactggtaccagacaaaaaccaatcagtctaccaagctcctcatcgagtctgccttcccagccccatgcacggggtcccctgagtcagtcgcagtgatcgtgggacngactttcaccctcaccatcagtcgcctggaacctgaagntgctgacaacatatactgtacaacgagagtagtgacctaccacctcactactttcggaccgaaggggaccaaggcctaggaacgaactaccgaaaacgtacgtaggtaaggctacggcaaccgtactcttacgtcc

SEQ ID NO: 306346 - DNA, 592 bp, Homo sapiens
  misc_feature: GZ8MTXP02HJ6BW.25.39.D06.1.454.CMB.2.raw
  modified_base (265)..(265): a, c, t, g, unknown or other
  misc_feature (265)..(265): n is a, c, g, or t
  modified_base (335)..(335): a, c, t, g, unknown or other
  misc_feature (335)..(335): n is a, c, g, or t
  modified_base (376)..(376): a, c, t, g, unknown or other
  misc_feature (376)..(376): n is a, c, g, or t
  modified_base (447)..(447): a, c, t, g, unknown or other
  misc_feature (447)..(447): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcgagggccgccagactgttgacaacgacttagcctggaccaacagaancctggccaggcctcccaggcctctcatctatgatacttccagtacggccacgtggcactcccagccccgnttcaggtggcccaggtgggtctggggactaggtatttaccnctacacctatcctccaagtccctagacgcctagaagtatttgctagtttattactgtacagtcctccgaanaagtacgtcgtacctactaattacgttacctacgtttccggacccgtaacgggaaacctaaaggtacgtaactacgtaaaccgtaaaacgtacgtcgtacggtcctacgaacctaactacgttcttcgttaccttactactcccg

SEQ ID NO: 306347 - DNA, 557 bp, Homo sapiens
  misc_feature: GZ8MTXP02HEUL4.25.39.D06.1.454.CMB.2.raw
  modified_base (499)..(499): a, c, t, g, unknown or other
  misc_feature (499)..(499): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaatttacactggtaccagacaaaaaccaatcagtctaccaaagcctcctcatcgagtctgccttcccagccccatcgtccgacggggtccccctggaggttcaggtcggcaggtggactcgtggggactgtactttccaccctcaccatcagtcgcctaggacctgaagatgctgacaacatattactgtacaacagagtagtcgctccactcactacgtttcggaccgacggggtaccaaggtcgtacgggaaanaacgtaacgaaacgtacgtcggtaacgtcgtacgacctacgtacgttcgttacgttcc

SEQ ID NO: 306348 - DNA, 512 bp, Homo sapiens
  misc_feature: GZ8MTXP02J3HMS.25.39.D06.1.454.CMB.2.raw
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (425)..(425): a, c, t, g, unknown or other
  misc_feature (425)..(425): n is a, c, g, or t
  modified_base (472)..(472): a, c, t, g, unknown or other
  misc_feature (472)..(472): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaatttacactggtaccagacaaaaaacccaaatccagtctaccaaagctcctcatcgagtcngcttcccagcccatgtcaggggtcccctgaggttcagtggcagtggatctggggacngctttcaccctnaccatcagtgcctggaacctgaagatgctgcaaacatattactgtacaacngagtagtgctccacctcacacttttggaccgaggggaccaaaggccngggacatacgaaaacgaactggngctcncacactctcgtc

SEQ ID NO: 306349 - DNA, 643 bp, Homo sapiens
  misc_feature: GZ8MTXP02I4YPU.25.39.D06.1.454.CMB.2.raw
  modified_base (263)..(263): a, c, t, g, unknown or other
  misc_feature (263)..(263): n is a, c, g, or t
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
tcagactgtacagtcacgaccggtgctcgatttagtgacatctcgcagttcttgggggaggaactgctcagttaggacccagagggaaccatggaagccccagctcagcttctcttcctcctgctactctggctcccagattccagcggcgaaactgtgttgacacagtctccagccaccctgtctttgtccgtccggggaacgagccaccctctcctgcagggccggccagactgttgacaacgacttagcctggtaccaanagaagcctggccaggcctcccaggcctcctcatctatgatacttccagtacggccagtggcactcccagccccgnttcaggtgccaggtgggtctggggacagtagtttacnctcaacctatcctaccgacgcctacgacgtaccgtagtaagtagtttgtacgtgtttaatttactcgtcgtacgtcgtccgacgaacgtaagacggctttcccgaaactaacttttacaacctttttcggggacccccctttagggggacccccaaaaaggttcgggaaaacgttaaacgttcctaaaaaccgggaaaccttacggttagggaccctttagggccgtaaccccgaattcccttaggttcccttttccgaactttcccg

SEQ ID NO: 306350 - DNA, 606 bp, Homo sapiens
  misc_feature: GZ8MTXP02I3B8N.25.39.D06.1.454.CMB.2.raw
  modified_base (333)..(333): a, c, t, g, unknown or other
  misc_feature (333)..(333): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgtgacaacgacttagcctggtaccaacagaagcctggccaggctcccaggctcctcatctatgatacttccagtacggccactggcatccccagccccgnttcagtgccaggtgggtctggggacagtagtttcnctcaccatcctccagccctagacncctagaagtattttgcttagtttattactgtacagtctccgacaaggtaacgtcggcctaacctaattacttacctaaccgtttccgggccccgttagggggaaaccctaaaaggtcgggtaacttaacgtaaccgtaaaaacggtaacgttacggtacggtaacctcggaaccgtaacccgtaattccttgttaccctttctaactttccccg

SEQ ID NO: 306351 - DNA, 593 bp, Homo sapiens
  misc_feature: GZ8MTXP02IXQIA.25.39.D06.1.454.CMB.2.raw
  modified_base (333)..(333): a, c, t, g, unknown or other
  misc_feature (333)..(333): n is a, c, g, or t
  modified_base (391)..(391): a, c, t, g, unknown or other
  misc_feature (391)..(391): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtacggccatggcatcccagccccgnttcagtggccaggtgggtctggggacaggtagtttctctcaccatcctccagcctagngcctagaagtattttgacttagttttattactgtcagtctccgacaaagtaagtcggacctaccaaattattacctaccgtttccggaccccgttagggggaaaccctaaaaggtaggtaacttaacgtactaaaaacggtaacgttacgtacggtacctaggaaccacctaacgttcctgttacctttctaactttccccg

SEQ ID NO: 306352 - DNA, 526 bp, Homo sapiens
  misc_feature: GZ8MTXP02HLAE9.25.39.D06.1.454.CMB.2.raw
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggagcttggtccagcctggagggtccgtgagagtctctgtgcagcctctggattcatcttcagtgaccactacatggactgggtccncaggcctcgagggagggctggagtgggtgcgtatagaaataagctaagagttacnccacagaatacgccgacgtctgagaaagcagattcattatctanaaganatagatacaaanactnatntatcagacaatagaacacgacaagaaaaccgaggacgacggtacgtagtacttacgtgtacgtaacgtaggacgacgtacgtacggtactacctacc

SEQ ID NO: 306353 - DNA, 536 bp, Homo sapiens
  misc_feature: GZ8MTXP02I4HP6.25.39.D06.1.454.CMB.2.raw
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (402)..(402): a, c, t, g, unknown or other
  misc_feature (402)..(402): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagcgtggtttctgttgttattttccaggtgtccagagtgaggtgcagttggtggagtcgtgggggagcttgggtccagcctggagggtccgtgagngtctcctgtgcagcctctggattcatcttcagtgaccatacatggactgggtccncaggctccgagggagggctggagtgggtgcgtatagaataagctaagagttacacacagaataccgcgcgtctgtagaaaggcagattcattatctanaagagatgaattacgaaaagtacttcaactgtaatctagacaatagaacagacgtacgaaacgaacgacgacggacgtacgtagttaacgtgtgtcgtacggtacgtacgacgtacggtacggtacttaacccg

SEQ ID NO: 306354 - DNA, 580 bp, Homo sapiens
  misc_feature: GZ8MTXP02HBPQT.25.39.D06.1.454.CMB.2.raw
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggcccaggcctcccaggcctcctcatctatgatacttccagtaggccatggcatcccagccccgnttcagtggcccaggtgggtctggggacaggtacgttttaccnctacacctatcctaccagccctagcgtcctagaagtatttgacttagtttattactgtacacgtcctacgacgtaagtagtcgacctactaattacttactaccgtttcggcccgtagggaaccgtaaaggtacggaacttaacgtaacgaaaacgtacgtacggtacgctacgaacctactacttctgtaccttactacttcc

SEQ ID NO: 306355 - DNA, 548 bp, Homo sapiens
  misc_feature: GZ8MTXP02GJLS8.25.39.D06.1.454.CMB.2.raw
tcagactgtacagtcacgaccggtgctcgatttagtgacatctcgcagttctttggggagctgtgggcttaggaagcagagcctggggcatctccaccatggcctggacccctctcctcctccagcttctcaccctctgctcagggtcctgggcacagtctgcgctgacccaggaagactcggtgtcggggaccgtgggacagaaagtcacctgtcttgttctggtacgagcgacaacattggaacgtatcctggtgggctggtaccaacagaatggtcacggtccccccaaaatgtgatgtctggagatgttccgccctcgagggactccccgtcgccccgtcttctcgtggggtcacgtgtcgtgggaccacacgcctccctgactagtccgcgggcctccagcctgacggacgaggctcggtactactgctcagcagtgggactcgtgagctcgctgctcgaggtcgttcggggcgggggtacccgtcggaccgtcgtacggtcacgccgacgctccgcccgtcgcactcgtcgtccccgcctcc

SEQ ID NO: 306356 - DNA, 503 bp, Homo sapiens
  misc_feature: GZ8MTXP02HFL78.25.39.D06.1.454.CMB.2.raw
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
  modified_base (399)..(399): a, c, t, g, unknown or other
  misc_feature (399)..(399): n is a, c, g, or t
  modified_base (495)..(495): a, c, t, g, unknown or other
  misc_feature (495)..(495): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccgggggaacagccaccctctcctgcagggccgccagactgttgacaacgcttagcctggtaccaacagaagcctggccaggctcccaggctcctcatctatgatacttccagtaggccactggcatcccagccccgnttcagtggcccaggtggtctggggacaggacgtttacnctcaccatctccagccctagagcctagaatnttttgctagtttatactgtcagctcgcaagtagtgcctacaatatcacttcgcctggacaaagtgactatacaaacgactgtacgctgcacatctntctcactc

SEQ ID NO: 306357 - DNA, 537 bp, Homo sapiens
  misc_feature: GZ8MTXP02JT06M.25.39.D06.1.454.CMB.2.raw
  modified_base (369)..(369): a, c, t, g, unknown or other
  misc_feature (369)..(369): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgtgacaacgacttagcctggtaccaacagaagcctggccaggctcccaggctcctcatctatgatacttccagtagggccagtggcatcccagccccgcttcagtggcccaggtgggtctggggacagtagtttcnctcaccatcctccagccctagacgccctagaagttattttgacttagtttaacttactgttcaagtcctccgacaaggagtcgcctactaattctctaccgttcgaccgtggaaccaagtgatatacaaagactgacgtcngaacacatcgtntaccttcactttccc

SEQ ID NO: 306358 - DNA, 618 bp, Homo sapiens
  misc_feature: GZ8MTXP02JEOK1.25.39.D06.1.454.CMB.2.raw
  modified_base (331)..(331): a, c, t, g, unknown or other
  misc_feature (331)..(331): n is a, c, g, or t
  modified_base (373)..(373): a, c, t, g, unknown or other
  misc_feature (373)..(373): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccggggaacagccaccctctcctgcagggccgccagactgttgacaacgacttagcctggtaccaacagaagcctggccaggctcccaggctcctcatctatgatacttccagtaggcccatggcatcccagccccgtnttcagttggcctaggtggtcgtaggggacagttacgtttccnctaccacctattccgtaccacgtccctaagacgtaccgtaagtaagttattttcgacttaagttttaacttactgtaccgagtcctaccgacgaaacggtacgtcgtaccctactaaagttacttactaccgtttccggacccgtagggaaacctaaaggtacggaattaactaaaccgtaaaacgtaacgttcgtacggtactacgaacctaaacgtacttctcgtttaccttactacttcccg

SEQ ID NO: 306359 - DNA, 500 bp, Homo sapiens
  misc_feature: GZ8MTXP02GQRIO.25.39.D06.1.454.CMB.2.raw
  modified_base (148)..(148): a, c, t, g, unknown or other
  misc_feature (148)..(148): n is a, c, g, or t
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagactgtacagtcacgaccggtgctcgatttagtgacatctcgcagttctttgggggcatgagcaaactgacaagtcaaggcaggaagatgttgccatcacaactcattgggtttctgctgctctgggttccagcctccaggggtnaaattatgctgactcagtctccagactttcagtctgtgactccaaaggcgaaagtcaccatcacctgccggcagtcgagcattggtactaattacactggtaccagacaaaaaccaatcagtctccaaagctcctnatcgagtctgcttcccagccccatgtcaggggtcccctgagttcagtgcagtggatcgtggacngattcacctnaccatcagtgcctggaacctgaagntgctgcaacatattactgtacaaangagttagngcctccaccttcaactctttggccaaggggaccaaagctaggacactacgaaaacgactgtcggctaggacaccatcctgttcc

SEQ ID NO: 306360 - DNA, 530 bp, Homo sapiens
  misc_feature: GZ8MTXP02GMM4L.25.39.D06.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (527)..(527): a, c, t, g, unknown or other
  misc_feature (527)..(527): n is a, c, g, or t
tcagactgtacagtcacgaccggtgctcgatttagtgacatctcgcagttctttggggctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctntggatttagttcagtggttctggcatgcacgtgggtccnccaggctccgaggcaaggggccgagtggttgcagttanagcacatgatggaagttcngaaatattatacagactcgtagaaacgggccattcacatctacagacgacaacttcccggaatattgtagttacttggaaaatgggtacagcctaggagagtcgaaggctggcctgtgtaacttgngtgacgagngtcggggagttggtagtagttacgtaccggggnacg

SEQ ID NO: 306361 - DNA, 560 bp, Homo sapiens
  misc_feature: GZ8MTXP02GZUF9.25.39.D06.1.454.CMB.2.raw
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggcagtcggagcattggtactaattacactggtaccagacaaaaccaatcagtctccaaagctcctcatcgagtctgccttcccagcccatcgtcgacggggtccccctgaggttcaggtcggcagtggatcgngggacngtcttcaccctcaccatcagtcgcctaggacctgaacgntgctgacaacatattactgtacaactagagtacgtacgcctaccacctcaaccttacgttttacgggacccgaacgggggtaacccaggtaccgtaggggaacacgtaccgaaaacgtaacgtggtaacggctacgacctacctacgtacgtacgtttccc

SEQ ID NO: 306362 - DNA, 500 bp, Homo sapiens
  misc_feature: GZ8MTXP02GUIW2.25.39.D06.1.454.CMB.2.raw
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (492)..(492): a, c, t, g, unknown or other
  misc_feature (492)..(492): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacgagccaccctctcctgcagggccggccagactgttgacaacgacttagcctggtaccaacagaagcctggccaggctcccaggctcctcatctatgatacttcagtaggccatggcatcccagccccgnttcagtggccagtgggtctggggacagagtttcnctcaccatctccagccctagngcctgaagattttgctagtttatactgtcagctcgcaagaagtgcctcaatatcactttcgcctgggacaaagtgatatcaaaacgactgtgctgaacacatcgtntctcatcg

SEQ ID NO: 306363 - DNA, 587 bp, Homo sapiens
  misc_feature: GZ8MTXP02JK8DE.25.39.D06.1.454.CMB.2.raw
  modified_base (376)..(376): a, c, t, g, unknown or other
  misc_feature (376)..(376): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccgccagactgtgacaacgacttagcctggtaccaacagaagcctggccaggcctcccaggcctcctcatctatgatcttccagtacgggccacgtggcactcccagccccgcttcaggtggcctaggtgggtctggggacaggtagtttcnctcacctatcctaccagcctagacgtcctagaagtattttgactagtttattactgtacagtctccgactaagtaacgtcggtaccctacctaattacttctacgtttccggacccgtagggaacctaaaaggtcggaattactaccgaaaacgtacgtcggtacggtcctagaacctaccgtacttcctgttccttacctactttccccg

SEQ ID NO: 306364 - DNA, 591 bp, Homo sapiens
  misc_feature: GZ8MTXP02GJFLZ.25.39.D06.1.454.CMB.2.raw
  modified_base (330)..(330): a, c, t, g, unknown or other
  misc_feature (330)..(330): n is a, c, g, or t
  modified_base (394)..(394): a, c, t, g, unknown or other
  misc_feature (394)..(394): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccgggggaacagccaccctctcctgcagggccgccagactgtgacaacgacttagcctggaccaacagaagcctggccatgctcccaggctcctcatctatgatacttccagtacggccactggcatcccagccccgnttcagtcggcagtgggtctgggacagtgtttacctcaccatctccagcctagacgcctgaagtntttgctagtttattactgtcagtctccgactaagaagtcggaccctaccaaattacttacctacgtttcccggtaccccgtacggggaaccctaaaaggttccggtaaattaacttaaaccgaaaacgtaaccgttacggttaacggtccgttaacggactaccccgtagttaccttcgtttcctttaccgtaaccg

SEQ ID NO: 306365 - DNA, 520 bp, Homo sapiens
  misc_feature: GZ8MTXP02INQDZ.25.39.D06.1.454.CMB.2.raw
  modified_base (363)..(363): a, c, t, g, unknown or other
  misc_feature (363)..(363): n is a, c, g, or t
  modified_base (440)..(440): a, c, t, g, unknown or other
  misc_feature (440)..(440): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcacctgccgggcagtcggagcattggactaatttacactggtaccagacaaaaaccaaatcagtctaccaaagctcctcatcgagtctgccttccccagccccatcgtcgacggggtccccctgaggttcagtcggcagtgatcgtgggacngtactttccaccctcaccatcagtcgcctggaacctgaagatgctgacaaacatattactgtacaacagagtagtcncctccactcactactttcggacgacggggaccagcgtaggagactacgaaaacgactagaaggctcgacacatctagtcc

SEQ ID NO: 306366 - DNA, 646 bp, Homo sapiens
  misc_feature: GZ8MTXP02HZO5A.25.39.D06.1.454.CMB.2.raw
  modified_base (359)..(359): a, c, t, g, unknown or other
  misc_feature (359)..(359): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtccgtccggggaacgacgcccaccctctcctgcgacgggccggccagactgttgacaacgacttagcctggtaaccaacagaacgccgtcggccgacggcctcccacggcctcctcatctatgactacttccagtacgggccacgtcggcactcccggggggggaccncccgtctccgaggtcggccgaggtgggtcgtggggacgtaggttacgtttctacctacacctactcctaccacgacctacgacgcgtagtaagtagtttgtacttagtttattacgtcgtcgacgtccgtacgacgaaggtaacgtacgtaccgtactaacttacttacttaccgtttaccggtacccgtacggtaaccgtaaacggtacggtaattaactaacgtaaaacgtaacgtacgtacggtacgtacgaaccgtactacttctacgttccttactactccg

SEQ ID NO: 306367 - DNA, 551 bp, Homo sapiens
  misc_feature: GZ8MTXP02FVP2P.25.39.D06.1.454.CMB.2.raw
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccatggcatcccagcccgnttcagtggccagtgggtctggggacagagtttcnctcaccatctccagccctagagcctgaagtattttgctagtttattactgtacagctccgacaagaagtcggcctaccaattacgttccaacgttttcggccctaggggaacccaaaaggtcggattaactacaaaacgtaactcgttaggtcgacaaccatcttcgtctttcacttcttaccccg

SEQ ID NO: 306368 - DNA, 539 bp, Homo sapiens
  misc_feature: GZ8MTXP02FVW2Q.25.39.D06.1.454.CMB.2.raw
  modified_base (288)..(288): a, c, t, g, unknown or other
  misc_feature (288)..(288): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggcagtcggagcattggtactaattacactggtaccagacaaaaccaatcagtctaccaaagctcctnatcgagtctgcttcccagccccatcgtcgacggggtccccctggaggttcaggtggcagtggatcgtgggacngtattccaccctcaccatcagtcgcctaggaacctgaagntgctgacaacatattacngtacaacagagtagtgacctccacctctactacgtttcggaccgtaacggggaccaaggcgtaggaagtactaccgaaaacgtacgttggcggtcctagacctaccgtatcctagtttcc

SEQ ID NO: 306369 - DNA, 520 bp, Homo sapiens
  misc_feature: GZ8MTXP02JGQ2A.25.39.D06.1.454.CMB.2.raw
  modified_base (387)..(387): a, c, t, g, unknown or other
  misc_feature (387)..(387): n is a, c, g, or t
  modified_base (426)..(426): a, c, t, g, unknown or other
  misc_feature (426)..(426): n is a, c, g, or t
  modified_base (510)..(510): a, c, t, g, unknown or other
  misc_feature (510)..(510): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgttgacaacgacttagcctggtaccaacagaagcctggccaggctcccaggctcctcatctatgatacttccagtagggccactggcatcccagcccgctcagtgccagtggtctggggacagagtttctctcaccatcctccagccctagacncctagaagtatttgactagtttattactgtcagctccgnaaagagtcggcctaccaattatctacgtttccggcctggaaccaagtggatatacaaacgtaactgtacggctgcacatccttntctcactccg

SEQ ID NO: 306370 - DNA, 614 bp, Homo sapiens
  misc_feature: GZ8MTXP02H5DCF.25.39.D06.1.454.CMB.2.raw
  modified_base (376)..(376): a, c, t, g, unknown or other
  misc_feature (376)..(376): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacgagccacctctcctgcagggccggccagactgttgacaacgacttagcctggtaccaacagaagcctggccaggcctcccaggcctcctcatctatgatacttccagtacggccagtggcactcccagcccgcttcagtggccaggtgggtctggggactagtacgttttacnccttcaaccctatcctaccagtccctagacgcccttaggaaagttattttgacttaagttttacttacgtgttcagtccgttccgacaaaggtagtcggacctaccaaattctacgtacgtttcggcccctaggggaacccaaaaggttggaattaacgtacgaaaaaccgtaacgttggtacggtccttaggaacctaaccgtaatcccgttagttccctttactaacctttccccg

SEQ ID NO: 306371 - DNA, 548 bp, Homo sapiens
  misc_feature: GZ8MTXP02F3MQ5.25.39.D06.1.454.CMB.2.raw
  modified_base (150)..(150): a, c, t, g, unknown or other
  misc_feature (150)..(150): n is a, c, g, or t
  modified_base (355)..(355): a, c, t, g, unknown or other
  misc_feature (355)..(355): n is a, c, g, or t
  modified_base (421)..(421): a, c, t, g, unknown or other
  misc_feature (421)..(421): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcgaaagtcaccatcacctgccgggcagtcgagcattggtactaattcactggtacagacaaaacaatcagtctaccaaagctcctcatcgagtctgccttcccagcccatcgtcgacggggtcccctgaggttcagtggacagtggatcgtgggacngtactttccacccttcaaccagtcagtcgacctaggaacctgaagactgctgacaacatacttacngtacaactagacgtagtcgacctaccacctctacgttacgtttggacccgagggggaccctaaggccgtaggaacgtactacgaaaacgtcgttaggcggctacgacctaccgtattccgtatttcc

SEQ ID NO: 306372 - DNA, 606 bp, Homo sapiens
  misc_feature: GZ8MTXP02JJE6H.25.39.D06.1.454.CMB.2.raw
  modified_base (287)..(287): a, c, t, g, unknown or other
  misc_feature (287)..(287): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacagcccacccctccctcgcgacgggccggccgacgactcgttgacaacgacttacgcctcgtaccaacagaagcctggccaggcncccacggctcctcactctactgatactcctacgtacggccactggcactcccacgcccgcctcgtagtcggcgagtgggtacgtggacgtagacgtttactctcacactctccacgcctacgacgcctagaagtatttttcgctaatttagttactgtcacgcttaccgacaaaggtaagtcgcccttaccaaattattcctacctttacgggccctaggggaacctaaaaggtggtaataacttaaccgaaaacgtaacgttcgttggacctcgccaacctacgttcttacgttacttcctaacttccctttcccccg

SEQ ID NO: 306373 - DNA, 592 bp, Homo sapiens
  misc_feature: GZ8MTXP02IEHXC.25.39.D06.1.454.CMB.2.raw
  modified_base (266)..(266): a, c, t, g, unknown or other
  misc_feature (266)..(266): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtcgtccgggggaacgagccaccctctcctgccagggccggccagactgttgacaacgacttagcctggtaccaanagaagcctggccaggcctcccgaggcctcctcatcgtatgaactacttcagtacgggcccagtggcatccccagccccgcttccgagtcggcctaggtcgggtctggggacaggtagttttcnctcacccagttcccncagccctagcgcctagaacgtatttgcttagtttatactgtcagtcctcgacaaagtagtcggaccttaccaattacttactacgtttccggacctacggggtaaccaaaaggttcggaattaactactaaaacggtaaacgttgacggtctacgctaacctagttcctcgttccttactacttcccc

SEQ ID NO: 306374 - DNA, 522 bp, Homo sapiens
  misc_feature: GZ8MTXP02JWPUK.25.39.D06.1.454.CMB.2.raw
  modified_base (361)..(361): a, c, t, g, unknown or other
  misc_feature (361)..(361): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaatttacactggtaccagacaaaaaccaatcagtctaccaaagctcctcatcgagtctgccttcccagcccatgtcacggggtcccctgaggttcagtcggcagtggatcgtggggacngtactttccacccctcaacccatccagtcggccctaggaaccctgaagatgctgacaacatattactgtacaacagagtagtgctccacctcactacgtttggaccgacggggtaccaagctaggagactacgaaaacgactgtggctcgcaccatctgtc

SEQ ID NO: 306375 - DNA, 652 bp, Homo sapiens
  misc_feature: GZ8MTXP02G806I.25.39.D06.1.454.CMB.2.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (368)..(368): a, c, t, g, unknown or other
  misc_feature (368)..(368): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccgggggaacagccacccctctcctgcagggccgccagactgttgacaacgacttagcctggtaccaacagaagcctggccaggcctcccgaggcctccncatctatgatacttccaggtaggccatggcatcccagcccnttcagtgccagtggtctgggacagtacgtttcnctacacctatcctaccagtccctagacgtccctagaaagttattttgacttaagttttattaccgtgtacctacgtcctacccgaagaaacggtaaaggtccggtacctaacccaaattacctttaccgttaaccgtttccgggaccccgttaaggggaaaccctaaaaggggttcggaaaactttaaacgtaacgtaaaaacccgaaacggtttcggtacgggtaccttacggaacccgtaacctaacttaccgttacgtttcctttacctaacgtttccccc

SEQ ID NO: 306376 - DNA, 547 bp, Homo sapiens
  misc_feature: GZ8MTXP02H9FBS.25.39.D06.1.454.CMB.2.raw
  modified_base (334)..(334): a, c, t, g, unknown or other
  misc_feature (334)..(334): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (399)..(399): a, c, t, g, unknown or other
  misc_feature (399)..(399): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggcccaggcctcccaggctcctcatctatgatacttccagtacgggccatggcatcccagcccgnttcagtgccagtgggtctggggacagtagtttcnctcaccatccncagtcctagcgcctgaagtntttgctagtttatactgtcagtctcgacaaggtagtcggacctaccaaattactctacgtttccggccctaggggaacctaaaaggtcggaacttatacaaaacgtaactgtacggtctgaaccaccattctacgtcttctacttccc

SEQ ID NO: 306377 - DNA, 549 bp, Homo sapiens
  misc_feature: GZ8MTXP02I6LZT.25.39.D06.1.454.CMB.2.raw
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctcggggaacagccacctctcctgcagggccggcagactgtgacaacgcttagcctggtaccaacagaagcctggccaggcctcccaggcctcctcatctatgactacttccagtacggccactggcactcccagccccgnttcagtcggccaggtgggtctggggacagtacgtttcncctcaccatcctacagcctagctcctagaaacgtattttgactagttttattactgtacagtcctcgacaaagagtcggccttacaattacttctacgtttccggacctaggaccaaagtggactaatacaaaacgaacgtcgtaggctacgaacaacctactctctcttactacttcc

SEQ ID NO: 306378 - DNA, 552 bp, Homo sapiens
  misc_feature: GZ8MTXP02IMXYE.25.39.D06.1.454.CMB.2.raw
  modified_base (288)..(288): a, c, t, g, unknown or other
  misc_feature (288)..(288): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcacctgccgggcagtcggagcattggtactaattacatggtaccagacaaaaccaaatcagtctaccaaagctcctnatcgagtctgccttcccagccccatcgtcacggggtcccctgagttcaggtcgcagtgatcgtggacngtactttcaccctcacctancagtcgcctaggaacctagaagatgctagacaaactatattactgtaccaaacgtagagtagcgacctcccacctacacgttacgtttacggacgaacgggtaacacggcgtacggtaagaactaaccgaaaacgttctacggtcgacctacgacctacgtacttccgtacgttcc

SEQ ID NO: 306379 - DNA, 618 bp, Homo sapiens
  misc_feature: GZ8MTXP02HAMDJ.25.39.D06.1.454.CMB.2.raw
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (415)..(415): a, c, t, g, unknown or other
  misc_feature (415)..(415): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacgagcccaccctctcctgcagggccggccagactgtgacaacgacttagcctggtaaccaacagaacgcctggccaggcctcccaggcctcctcatctatgatacttcagtacggccacgtggcactccccagccccgnttcagtgcctaggtgggtctggggacaggtagtttccnctcacctatcctccagccctagacgcctagaaagttntttgacttagtttattacgtagtactacgtcctaccgaacgaacgtagtccgtaccctaactaattacttaccgttaccgttccggtacccggtacgggaaacctaaaggtacgtaacttaacgtaaacgtaaaacggtacgttacggtacgtccgtacgaaccctaaccgtacttacgtacgttaccttacctaccttcccg

SEQ ID NO: 306380 - DNA, 567 bp, Homo sapiens
  misc_feature: GZ8MTXP02JOE7G.25.39.D06.1.454.CMB.2.raw
  modified_base (150)..(150): a, c, t, g, unknown or other
  misc_feature (150)..(150): n is a, c, g, or t
  modified_base (230)..(230): a, c, t, g, unknown or other
  misc_feature (230)..(230): n is a, c, g, or t
  modified_base (290)..(290): a, c, t, g, unknown or other
  misc_feature (290)..(290): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcaaagtcaccatcacctgccgggcagtcggancattggtactaattacactggtaccagacaaaaaccaatcagtctaccaaagcctcctanatcgagtcctgccttcccagtccccatcgtccgacggggtccccctgaggttcagtcggcaggtggatcgtaggggactaggtactttccaacccctcaaccatccgaggtcggcctaggaacctgaagntgctgacaactatattacngtacaactagtataggtcncctacctacctctaccgttacggtttacggacccgaaggggaaccctaggacgtacggaagtactacgaaaacgtacgtgaacggctacggaccacacttcgtcttacc

SEQ ID NO: 306381 - DNA, 726 bp, Homo sapiens
  misc_feature: GZ8MTXP02ITWQG.25.39.D06.1.454.CMB.2.raw
tcagactgtacagtcacgaccggtgctcgatttagtgacatctcgcagttctttgggggaggaactgctcatttaggacccagagggaaccatggaagccccagctcagcttctcttcctcctgctactctggctcccagattccagcggcgaaactgtgttgacacagtctccagccacctgtctttgtctccggggaacagccaccctctcctgcagggccgccagactgtgacaacgacttagcctggtaccaacagaagcctggcccaggcctcccgaggcctcctcatctatgatacttccagtacggccagtggcactcccagcccgcttcagtgcctaggtcgggtctgggacaggtacgtttactcctacacctatccttaccaagtcccctaagacgtacccttaggaaacgttactttttcggacttaaggttttacttaacttcggtacctacggtacccttacccggtacgaaaacgggtaacggttaccgggtacccccttaaccgtaaaacgtttaccttacccgttaaaccggtttttaccccgggggccccctttaaaggggggaaaaccccctaaaaagggtttccggggtaaatttaaaccgtaaaccgaaaaacccggttaacgttacggggttaccgggaccttacgggaaccctaaacccgtaattcccggttggtttaccccgtttactaactttaccccccgg

SEQ ID NO: 306382 - DNA, 583 bp, Homo sapiens
  misc_feature: GZ8MTXP02FQSGI.25.39.D06.1.454.CMB.2.raw
  modified_base (292)..(292): a, c, t, g, unknown or other
  misc_feature (292)..(292): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacccgtctttgtcgtccgggggaacgagccaccctctcctgcagggccggccagactgttgacaacgacttagcctggtaccaacagaagcctggccaggcctcccaggctccncatctatgattaccttccaggtacggccacgtggcactccccagcccgcttcagtggcaggtgggtctggggacaggtagtttactcgtcaacctatcctccaagcctaagacgcctagaagtatttgcttagtttattactgtcagtcttaccgacaaagacgtcgacctacctaaattacttctaccgtttcggcccgtacggaaccgtaaaggtacgtaataactacaaaacgtaacgtaggtcgactcgacaaccgtattcttacgtccttacacttcccttacccg

SEQ ID NO: 306383 - DNA, 585 bp, Homo sapiens
  misc_feature: GZ8MTXP02F6L7O.25.39.D06.1.454.CMB.2.raw
  modified_base (358)..(358): a, c, t, g, unknown or other
  misc_feature (358)..(358): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtgaaattatgctgactcagtctccagactttcagtctgtgactccaaaggcgaaagtcacatcacctgccggcagtcgagcattggtactaatttacactggtaccagacaaaaaccaatcagtctaccaaagcctcctcatcgagtctgccttcccagccccatcgcgacggggtcccctgaggttcagtcggcagtgatcgtggacngtcttccaccctcacctatcgagtcggtacctaggaaccctggaaagtatcgctgacaactatacttacgtgtactaacgagtagtacggtactcccttacccaaccttccgtaacttaccgtttacgggaccggtaacgggggaacccaaggtccgttacggggaaactaacgtaaaccgaaaacgtacgtaggtcggacctcgaccacctatccgttgtttaccc

SEQ ID NO: 306384 - DNA, 540 bp, Homo sapiens
  misc_feature: GZ8MTXP02FTMS4.25.39.D06.1.454.CMB.2.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (469)..(469): a, c, t, g, unknown or other
  misc_feature (469)..(469): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtgggggagcttggtccagcctgggagggtccgtgagngtctcctgtgcagcctntggattcatcttcagtgaccatacatggactgggtccncaggctcgagggagggctggagtgggtgcgtatagaaataagctaagagttacacanagaataccgcgngtctgtagaaagcagattcattanctanaagagatgtattacaaaagactcactgtaatctagacaaatgaaacagaccgtaagaaaaccggnggaacacggactaagttacgtaattacgtgtaagtacgtaggtaccaaggtaccgtacgggtactaaaccc

SEQ ID NO: 306385 - DNA, 515 bp, Homo sapiens
  misc_feature: GZ8MTXP02FOH2B.25.39.D06.1.454.CMB.2.raw
  modified_base (331)..(331): a, c, t, g, unknown or other
  misc_feature (331)..(331): n is a, c, g, or t
  modified_base (384)..(384): a, c, t, g, unknown or other
  misc_feature (384)..(384): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgttgacaacgacttagcctggtaccaacagaagcctggccaggctcccaggctcctcatctatgatacttccagtaggccatggcatcccagccccgnttcagtggccagtgggtctgggacagagtttcctcacatcctcagccctagancctgaagtattttgctagtttattactgtacagctccgcaagaagtggcctacaactattcactttcggcctagggaccaaagtggatatacaaacgaactgtcggctgcaccatctgtacttcacttccc

SEQ ID NO: 306386 - DNA, 540 bp, Homo sapiens
  misc_feature: GZ8MTXP02HD781.25.39.D06.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggtttccttgttgttattttccaggtgtccagagtgaggtgcagttggtggagtcgtgggggagcttggtccagcctggagggtccgtgagngtctctgtgcagcctctggattcattcttcagtcgaccactanatggacgtggtcccgcaggctccgaggggagggctggaggtgggtggccgtagtagaaataagactaagagttacacanaagaactacgcgcgctgtacgaagcagactanattatccgtaanaaganatagtatacaaatactanatatatacanaanaagacaanacgactaagaaaacgacgacgacggtactagtactacgtgtacgtaacgtacgtacgacgtacgtacggtactacctacc

SEQ ID NO: 306387 - DNA, 586 bp, Homo sapiens
  misc_feature: GZ8MTXP02HUBYX.25.39.D06.1.454.CMB.2.raw
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (440)..(440): a, c, t, g, unknown or other
  misc_feature (440)..(440): n is a, c, g, or t
  modified_base (572)..(572): a, c, t, g, unknown or other
  misc_feature (572)..(572): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtctccgggggaacgagccaccctctcctgcagggccggccagactgttgacaacgacttagcctggtaccaacagaacgcctggcccaggcctcccgaggcctcctcatctatgatacttccagtagggccatggcactcccagcccgntttcagtggcctaggtgggtctggggacaggngtttcnctcaccntcncagcctagngcctgaagtattttgctagttttattactgtcagtcctccganaaaggtaacgtcgacccttaccaaattactttacctaacgttttcccggacccgtttacggggaaccctaaaaggttgggtaaaacttacgtaaaccaaaacggtaactggtacgctgaaccacctatcgtnttcttcactttccc

SEQ ID NO: 306388 - DNA, 540 bp, Homo sapiens
  misc_feature: GZ8MTXP02GZY6H.25.39.D06.1.454.CMB.2.raw
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
  modified_base (364)..(364): a, c, t, g, unknown or other
  misc_feature (364)..(364): n is a, c, g, or t
  modified_base (431)..(431): a, c, t, g, unknown or other
  misc_feature (431)..(431): n is a, c, g, or t
tcagactgtacagtcacgaccggtgctcgatttagtgacatctcgcagttctttggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgcagactgttgacaacgacttagcctggtaccaanagaagcctggccaggctcccaggctcctnatctatgatactccagtaggccatggcatccccagccccgnttcagtggccaggtgggtctggggacagagtttccnctcacctatctccagcctagacgcctagaagtatttgactagtttaattacgtgtacagcctccganaaagtaagtcgaccctacaaattacttctactttccggaccctagggaaccaaaaggtcgaatactaacaaaacgactgacgctacgaacaccactctgtcttctactc

SEQ ID NO: 306389 - DNA, 524 bp, Homo sapiens
  misc_feature: GZ8MTXP02GPUHV.25.39.D06.1.454.CMB.2.raw
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaattacactggtaccagacaaaaaccaatcagtctaccaaagctcctcatcgagtctgccttcccagccccatgtcaggggtccccctgaggttcaggtcgcagtggatcgtgggacngtactttcaccctnaccatcagtgctgacngaagntgctgcaacatattactgtacaacagagtagtgcctccacctcacctacgtttcgggaccgtaagggggacccaaggtctaggacgactaccgaaaacgtactgtaaggctcgaccacactctcgttcc

SEQ ID NO: 306390 - DNA, 553 bp, Homo sapiens
  misc_feature: GZ8MTXP02FLPYU.25.39.D06.1.454.CMB.2.raw
  modified_base (149)..(149): a, c, t, g, unknown or other
  misc_feature (149)..(149): n is a, c, g, or t
  modified_base (358)..(358): a, c, t, g, unknown or other
  misc_feature (358)..(358): n is a, c, g, or t
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcaaagtcaccatcacctgccgggccagtcggagcattggtactaattacactggtaccagacaaaaaccaaatcagtctaccaaagctcctcatcgagtctgccttcccagcccatgtcacggggtcccctgaggttcagtcggcagtggatcgtgggacngactttcaccctcaccatcagtcgcctaggaaccctgaagatgctgacaacatacttactgtacaacgagtagtagtcgtcctccaccttcaactaccgtttcggaccgaaggggtaacccaaggtcctagggaacgtactacgaaaacggacttaggtaacgggtctacggacctaacctattccgtcgttacc

SEQ ID NO: 306391 - DNA, 598 bp, Homo sapiens
  misc_feature: GZ8MTXP02HEAT5.25.39.D06.1.454.CMB.2.raw
  modified_base (334)..(334): a, c, t, g, unknown or other
  misc_feature (334)..(334): n is a, c, g, or t
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
tcagactgtacagtcacgaccggtgctcgatttagtgacatctcgcagttctttgggggaggaactgctcagttaggacccagagggaaccatggaagccccagctcagcttctctcctcctgctactctggctcccagattccagcggcgaaactgtgttgacacagtctccagccaccctgtctttgtctccgggggaacagccaccctctcctgcagggccggccagactgtgacaacgacttagcctggtaccaacagaagcctggcccaggcctcccaggcctcctcatctatgatacttccagtaggccactggcatcccagccccgnttcagtggccaggtggtctgggacagtagtttcnctcaccatcctcagccctagacgcctagaaagtttntttgacttagtttatactgtacacgtcctaccgagtaaaggtacgtcgtacctacctaattactaccttacgttcccggaccgtaacgggaaacctaaaggttacgtaactaaacgtaaaccgtaaaacgtaacgtcggtacgtaccgtacgaaccctaacgtacttcctacgtttaccttacctaccttcccg

SEQ ID NO: 306392 - DNA, 575 bp, Homo sapiens
  misc_feature: GZ8MTXP02IRYQI.25.39.D06.1.454.CMB.2.raw
  modified_base (334)..(334): a, c, t, g, unknown or other
  misc_feature (334)..(334): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgataccttccagtaggccatggcactcccagccccgnttcagtggccagtggtctgggacagagtttactctcacctatcctacagccctagacgtcctagaagtattttgactagtttattactgtcagctccgacaagaagtcggaccttacaattacttctaccgtttccgggcccttaggggaacctaaaggtacggtaaatataaccgtaaaacgtaaccgtagtacggccgttagaaccgtaaccctattcctcgttacctttcactttccc

SEQ ID NO: 306393 - DNA, 585 bp, Homo sapiens
  misc_feature: GZ8MTXP02H0AUJ.25.39.D06.1.454.CMB.2.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcactgccgggcagtcggagcattggtactaatttacactggtaccagacaaaaaccaatcagtcacaaagctcctcatcgagtctgccttcccagccccagtcgtcgacggggtcccctgaggtcagtcggcagtggatcgngggacngtctttcacccctnaaccatcagtgcctggaacctgagatgctgacaacatatactagtcaagagtataggtcacctcccaaccttccaacgttaccgttttcgggacccgtaaacgggggacccaaaacgggtcccgttaaaggggacgaaacttaccgaaaaaccgtaaccgttggtaaccgggccttaggacccctaacccaacgtttcccttaggtttcccc

SEQ ID NO: 306394 - DNA, 525 bp, Homo sapiens
  misc_feature: GZ8MTXP02JK3CI.25.39.D06.1.454.CMB.2.raw
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggaggcttgggtccagcctgggagggtccgtgagagtctcctgtgcagcctctggattcatcttcagtgaccactacatggactggggtccnccaggctccgagggaaggggctggagtgggtggccgtattagaaataagctaagagttacaccanagaatacgccncgtctgtagaaaggcagattcattatctcaagngatgaattacaaagaactacactgtatctgacaatagaanagacctagaaaaccgngaacacggcgtagtactacngtgcgtagtacagactacggtgactacc

SEQ ID NO: 306395 - DNA, 611 bp, Homo sapiens
  misc_feature: GZ8MTXP02FSMGU.25.39.D06.1.454.CMB.2.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (447)..(447): a, c, t, g, unknown or other
  misc_feature (447)..(447): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcacctgccggccagtcgagcattggtactaattacactggtaccagacaaaaaccaatcagtctaccaaagctcctnatcgatctgccttccccagccccatcgtccgacggggtcccccctgaggttcagtcggcagtgatcgtgggacngactttcaccctcacctatccagtcgccctggaacctgaagatgctagacaacattacttactacgtacaaacgagtacgtaggtnacccttacccacccttaacaaccgttaacgttttccggggacccgaaacgggggtaacctaaacgggccgttaggggaaacgtaaacttaaaccgtaaaaaacccgggtacgtacggtaaccggtaccgtacgacccgtaacctacgtttccgttcggttaccc

SEQ ID NO: 306396 - DNA, 486 bp, Homo sapiens
  misc_feature: GZ8MTXP02I94G8.25.39.D06.1.454.CMB.2.raw
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagacttttcagtctgtgactccaaaggcgaaagtcaccatcacctgccgggcagtcgagcattggtactaattacactggtaccagacaaaaaccaaatcagtctacaaagctcctcatcgagtctgccttcccagcccatgtcaggggtccccngagtcagtgcagtgatctgggacngattcacctnaccatcagtgctggaactgaagatgctgacaacatattactagtacaacagagtagtcncaccactacactcgttcgacgacggacagcaganacacaaacgactagngcacgacacactctntc

SEQ ID NO: 306397 - DNA, 561 bp, Homo sapiens
  misc_feature: GZ8MTXP02J2SCT.25.39.D06.1.454.CMB.2.raw
  modified_base (221)..(221): a, c, t, g, unknown or other
  misc_feature (221)..(221): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
tcagactgtacagtcacgaccggtgctcgatttagtgacatctcgcagttctttggggagctgtgggcttaggaagcagagcctggggcatctccaccatggcctggacccctctcctcctccagcttctcaccctctgctcagggtcctgggcacagtctgcgctgacccaggaagactcggtgtcgggacctgggacagaaagtcaccctgtctgttcnggtacgagcgacaacattggaacgtatcctgtgggctggtaccaacagaatggtcacggtcccccaaaactgtgatgtctggagatgttccgccctcagggactccctgccccgcttctcctggggtcagtgtctgggaccacagcctccctgactatcgcgggcctccagccctgagacgaggctcggtactacngctcagcatggacncgtgagctcgccncgcgtcgtcggtcggttcgggccgggggtcccgggtccggtaccggtccgtacggtacgacgaccgaccggccgtccgtccccgtccgtccgtacctccgtccgtcccgtccctccc

SEQ ID NO: 306398 - DNA, 634 bp, Homo sapiens
  misc_feature: GZ8MTXP02FIOBO.25.39.D06.1.454.CMB.2.raw
  modified_base (183)..(183): a, c, t, g, unknown or other
  misc_feature (183)..(183): n is a, c, g, or t
  modified_base (202)..(202): a, c, t, g, unknown or other
  misc_feature (202)..(202): n is a, c, g, or t
  modified_base (336)..(336): a, c, t, g, unknown or other
  misc_feature (336)..(336): n is a, c, g, or t
  modified_base (381)..(381): a, c, t, g, unknown or other
  misc_feature (381)..(381): n is a, c, g, or t
tcagactgtacagtcacgaccggtgctcgatttagtgacatctcgcagttctttggggaggaactgctcagttaggacccagagggaaccatggaagccccagctcagcttctcttcctcctgctactctggctcccagattccagcggcgaaactgtgttgacacagtctccagccaccctntcttgtcgtcggtaacganccacctctctgcaggccggcagactgttgacacgacttagcctggtaccacagaacgcctggcccaggcctcccaggcctcctcatctatgactacttccaggtacgggcccacgtggccatccccagccccgnttcaggttggcccaggttggtctaggggaccagtacttttacccnctacacctctctcacgactacgtacgtacgtagtaagtagttacgtactagtttacttacttcgtacgtacgtccgtaccgacgaacgtacgtaccggtacccgtacctaccttacttaccgttaccgttacccggtacccggtaccgggtaaccgtaaacggtaacggtaacgtaactaaaccgtaaaccgtaacgtacgtacgtacgtaccgtaaccgacctacttcgttacgtaccttacctacctcccg

SEQ ID NO: 306399 - DNA, 530 bp, Homo sapiens
  misc_feature: GZ8MTXP02JJ0I3.25.39.D06.1.454.CMB.2.raw
  modified_base (288)..(288): a, c, t, g, unknown or other
  misc_feature (288)..(288): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccgccagactgtgacaacgcttagcctggtaccaacagaagcctggccaggctcccaggcctcctnatctatgatacttccagtaggccatggcactcccagccccgnttcagtcgccagtcgggtctggggacaggtagtttcnctcacctatcctccagccctagcgtcctagaagtatttgactagtttattactgtcagtctcgacaagagtcgcctacatctcacttcgcctggaccaagtcgatatacgaaacgtactgtacgtctacgaactacctactcgtactaccttacactttcccg

SEQ ID NO: 306400 - DNA, 546 bp, Homo sapiens
  misc_feature: GZ8MTXP02JIXMW.25.39.D06.1.454.CMB.2.raw
  modified_base (284)..(284): a, c, t, g, unknown or other
  misc_feature (284)..(284): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtgaaattatgctgactcagtctccagtactttcagtctgtgactccaaaggcaaatcacatcacctgccggcagtcgagcattggtactaattacactggtaccagacaaaaaccaatcagtcaccaaagctccncatcgagtctgcctcccagccccatcgcacggggtcccctgagttcagtcgcagtgatcgtggacngtnttccacctcacatcagtgcctgaacctgaagatgctgacaactatacttacngtacaacgagagtagtcnctaccacctcaactcgtttacggaccgtaacggggaccaaaggtccgtcggggaaaataacgtaaaccgaaaacgtaacggtaggtcggacgtacggacctaccgtacgttccgttacgttcg

SEQ ID NO: 306401 - DNA, 578 bp, Homo sapiens
  misc_feature: GZ8MTXP02JKJRX.25.39.D06.1.454.CMB.2.raw
  modified_base (376)..(376): a, c, t, g, unknown or other
  misc_feature (376)..(376): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcgagggccggccagactgtgacaacgacttagcctggtaccaacagaagcctggccaggcctcccaggcctcctcatctatgatacttccagtaggccatggcactcccagccccgtcttcaggtggccaggtggggtctggggacagtacgtttaccnctcacctatcctccagcctagacgcctagaacgtattttgacttagtttattactgtcacgtctcgagaagaacgtcggacctactaattactaccttacgttccggacccgtagggtaaccaaaggtcggaatacgtaacgtaaacgacgttcgtacggctacgaaccgtaacctattcgttcgtccttactactttcccg

SEQ ID NO: 306402 - DNA, 529 bp, Homo sapiens
  misc_feature: GZ8MTXP02J2D1H.25.39.D06.1.454.CMB.2.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaacgcctggcccaggcctcccaggcctcctnatctatgatacttccagtaggccactggcatcccagccccnttcagtgccagtgggtctggggacagtagtttcnctcaccatctccagccctagagtcctagaagtatttgctagtttattactgtcagctccgacaagagtcggcctacaatacttcacctttcggacccttagggaaccaaaagtcgatagtacaaaacgactgtcggactgcacatctgtcttcacttcc

SEQ ID NO: 306403 - DNA, 568 bp, Homo sapiens
  misc_feature: GZ8MTXP02HADIQ.25.39.D06.1.454.CMB.2.raw
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (313)..(313): a, c, t, g, unknown or other
  misc_feature (313)..(313): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (465)..(465): a, c, t, g, unknown or other
  misc_feature (465)..(465): n is a, c, g, or t
  modified_base (525)..(525): a, c, t, g, unknown or other
  misc_feature (525)..(525): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttattttccaggtgtccagagtgaggtgcaggttgggtggagtcgtgggggagtcttggtccagccgtgggagggtccgtgagagtctcctgtgcngcctntggattcatcttcagtcgaccactacatggactgggtccnccgaggctccgaggggagggctgggagtggggtcgcgtataagaaataagctaagagtacaccatagaataccgccgtcgtcngtagaaaggcagattacgattatcctanaagganatgaattaccgaaaatactanacgtgtactcgtanaacaagtagacgaacgacgaacgaaaacgacggaccgaccggtacgtacgtacgttacgngtacgtaacgtagacgtacgtacgtaccgtactacctaacccg

SEQ ID NO: 306404 - DNA, 579 bp, Homo sapiens
  misc_feature: GZ8MTXP02F1D3D.25.39.D06.1.454.CMB.2.raw
  modified_base (230)..(230): a, c, t, g, unknown or other
  misc_feature (230)..(230): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcaaagtcaccatcacctgccggccagtcggancattggtactaattacactggtaccaagacaaaaccaatcagtctaccaaagctacctcatcgagtctcgccttcccagccccatcggtccacggggtccccctgaggttcagtcggcagtggatcgnggactgtactttccaccctcaccatcagtgcctaggacctagaagntgctgactaacatacttactacgtacaaacgtagtacgtaggtactccctaccaacctcctaacgttacgtttacgggacccgtaacgggggaaccaaggaccgtagggaacgtaacgtaccgaaaaacgtacgtggtaacggacttacggaccacctactccgttacgtttccc

SEQ ID NO: 306405 - DNA, 547 bp, Homo sapiens
  misc_feature: GZ8MTXP02F4J3Z.25.39.D06.1.454.CMB.2.raw
  modified_base (361)..(361): a, c, t, g, unknown or other
  misc_feature (361)..(361): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccacctctcctgcagggccgcagactgttgacaacgacttagcctggtaccaacagaagcctggccaggctcccaggctcctcatctatgatacttccagtaggccatggcatcccagcccgcttcagtggccagtggtctggggacagagtttcnctcaccatcctcagccctagagcctgaagtattttgactagtttattactgtacagtctccgacaaggaagttcggaccctaccaaattacttcctaacgttttccgggaccccttaggggaaccctaaaaggtcggaatatacaaaacgtaactgtacggctagcaccatctgtcttcacttccc

SEQ ID NO: 306406 - DNA, 567 bp, Homo sapiens
  misc_feature: GZ8MTXP02HXEUH.25.39.D06.1.454.CMB.2.raw
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagtactttcagtctgtgactccaaaggcgaaagtcaccatcacctgccgggcagtcgagcattggtactaattacatggtaccagacaaaaaccatcagtcacaagcctctcatcgagtctcgcctcccagccccatcgtccgacggggtcccctggaggtcaggtcggcaggtgatcgnggactgtcttcaccctnacctatcacgtcgccctaggaaccctgaaagtntagcctagaccaatattaacttactagtaccaagtagtagtacgtcaccctcccactctaaccttacgtttcgggacccggaaacggggaccaaaggtccgtacggaagtaactaaccgaaaacgtacgtggtaacggctacgccaaccgttcttcgttacgttc

SEQ ID NO: 306407 - DNA, 554 bp, Homo sapiens
  misc_feature: GZ8MTXP02F1DWU.25.39.D06.1.454.CMB.2.raw
  modified_base (260)..(260): a, c, t, g, unknown or other
  misc_feature (260)..(260): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctctgcagggccgcagactgttgacaacgacttagcctggtacccaanagaagcctggccaggctcccaggctcctcatctatgatactccagtaggccactggcatcccagccccnttcagtggccagtgggctggggacaggagtttccnctcaccatcctccagcctagacgcctagaatntttgctagtttattactgtacagtcctccgacaagagtcgaccctacaattacttactacgtttccggcccgtacgggaaccaaggtacgtactactaaccgaaaacgtactaggtacggccgtacgaacctactactcgtcgttctactacttcccg

SEQ ID NO: 306408 - DNA, 527 bp, Homo sapiens
  misc_feature: GZ8MTXP02FQPJG.25.39.D06.1.454.CMB.2.raw
  modified_base (152)..(152): a, c, t, g, unknown or other
  misc_feature (152)..(152): n is a, c, g, or t
  modified_base (296)..(296): a, c, t, g, unknown or other
  misc_feature (296)..(296): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccgaggggtnaaattatgctgactcagtctccagactttcagtctgtgactaccaaaggcaaagtcacatcacctgccggcagtcgagctattggtaactaattacacgtggtaccaagaacaaaaaaccaatcagtactaccaaagcctccanagtcgagtctgccttccccagcccatcgcgacggggttccccctgaggttcagtcggctagtggatcgtagggactgtacttcaccctcacctatcagtgcctagaacctgaagntncanacaanatatatanacanagagtagtanctccactactactacgttacgtacgacggacgaacgacgacgagaacaacaaacgaacgtacgtgacgacacacactactactc

SEQ ID NO: 306409 - DNA, 540 bp, Homo sapiens
  misc_feature: GZ8MTXP02FGF9S.25.39.D06.1.454.CMB.2.raw
  modified_base (364)..(364): a, c, t, g, unknown or other
  misc_feature (364)..(364): n is a, c, g, or t
  modified_base (529)..(529): a, c, t, g, unknown or other
  misc_feature (529)..(529): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggcagactgttgacaacgacttagcctggtaccaacagaagcctggccaggctcccaggctcctcatctatgatacttccagtaggccatggcatcccagcccgctcagtggccagtgggctggggacagagtttaccnctcacatctcacgctagacgtcctagtaagtatttgactagtttacttacgtgtacacgtcctaccgacaagagtcggtacctactaacttacttacctacgtttccggaccgtaggaaccaaaggtcgaatactaacaaacgtactcgtcgctgaacacatctntctctactccg

SEQ ID NO: 306410 - DNA, 658 bp, Homo sapiens
  misc_feature: GZ8MTXP02JHSKL.25.39.D06.1.454.CMB.2.raw
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtnaaattntgctgactcagtcctccagtactttcagtctgtgactaccaaaggcaaatcacatcaccgtgccggcagtcgganctattggtaactaattacacgtggtaaccagaacaaaacatcagtcacaagctcanatcgatctgcctcccagcccctagtcgtccgacggggtccccctaggtacggttcaggtcggactaggtgactcgtagggactagtcttccgaccctacacctatcgagtcgacctacggaactaggaacgtagtcgacgtacgaacctaaagtacttaacgttaacgtacggttaaaccaaacgtaagggttaacggttacggtacctacccctaccctaacccgtaacttaaccgtttaccggtttaaccggggaccccggtaaaacgggggaaccctaacggtaccggtacggggaaactaaccgtaaacgaaaacgtacgttaggaacggtaccacggtaccaactacggtttccgtacgtttccc

SEQ ID NO: 306411 - DNA, 564 bp, Homo sapiens
  misc_feature: GZ8MTXP02IOTXK.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgtgacaacgacttagcctggtaccaacagaagcctggccaggcctcccaggcctcctcatctatgactacttccagtacggcccagtggcactccccagccccgcttcgaggtcggcccaggtcggggtctggggaactaggttacgtttcctctacctaaccattccctccagtccctaagacgtccgtagaagtattttgacttaagtttattactgtctagctccgataagtagtcggcctactaatacttactacgttcggccgtaggaccaaagtcgatatacaaacgtactcgtacgctgcctacattctatcttactacttccc

SEQ ID NO: 306412 - DNA, 648 bp, Homo sapiens
  misc_feature: GZ8MTXP02JNHV7.25.39.D06.1.454.CMB.2.raw
  modified_base (151)..(151): a, c, t, g, unknown or other
  misc_feature (151)..(151): n is a, c, g, or t
  modified_base (287)..(287): a, c, t, g, unknown or other
  misc_feature (287)..(287): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtnaaattatgctgactcagtctccagtactttcagtctgtgactaccgaaaggcgaaagtcaccatcacctgccggcagtcggagctattggtactaattacactggtaccagacaaaaccaatcagtcacaagctcncatcgagtctgcctcccagccccagtcgtccgtacggggtcccctgacggtcaggtcggactaggtgactcgtagggactaggtactttcccaaccccttacaaccctagttaccgaacggttccgggacccttagggaaaccctagggaaagtacgtggacctacgaaccctaaagtacttaaacttacgtgtaaaccaaagtagtacggtaagtcgtacctacccaacctactaaaccgttcgtttacgggacccgtaaacggggaaccctaaaggccggtagggaaacgtaacttaacccgaaaaacgtacgttaggtaacggactacggaccctaccgtacttccgtactttacccg

SEQ ID NO: 306413 - DNA, 523 bp, Homo sapiens
  misc_feature: GZ8MTXP02JLV0D.25.39.D06.1.454.CMB.2.raw
  modified_base (288)..(288): a, c, t, g, unknown or other
  misc_feature (288)..(288): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaattacactggtaccagcaaaaaccaatcagtctaccaaagctccncatcgagtctgcttcccagccccatcgtcgaggggtcccctgagttcaggtcggcagtgatcgtgggacngtattcaccctnaccatcagtcgcctggaacctgaagatgctgacaacatattactgtacaacagagtagtgctaccactcactacgtttcggacctaggggacccaaggcgtaggagtactacgaaaacgacctaggtcggctacgacaccattctcgtttacc

SEQ ID NO: 306414 - DNA, 577 bp, Homo sapiens
  misc_feature: GZ8MTXP02JYFDB.25.39.D06.1.454.CMB.2.raw
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (420)..(420): a, c, t, g, unknown or other
  misc_feature (420)..(420): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaattacactggtaccagacaaaaaccaatcagtcaccaaagctcctcatcgagtctgcttcccagcccatcgtcacggggtcccctgtaggtcaggtcggcaggtcggatcgtgggacnggtacttcaccctnaccatcagtgacctaggaacctggaaactgtgcctagacctaaanattaattaacgtgtaaccaagagtagtacgtcgcctaccacctactaacttccgtttgggacccgtaagggggaacctaaaggcgtacggggaataactaccgaaaaaccggttacgtggtaacgactacgacccaacgtacgttccttacgttacc

SEQ ID NO: 306415 - DNA, 544 bp, Homo sapiens
  misc_feature: GZ8MTXP02F624R.25.39.D06.1.454.CMB.2.raw
  modified_base (150)..(150): a, c, t, g, unknown or other
  misc_feature (150)..(150): n is a, c, g, or t
  modified_base (230)..(230): a, c, t, g, unknown or other
  misc_feature (230)..(230): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcgaaagtcaccatcacctgccgggcagtcgancattggtactaattacactggtaccagacaaaaaccaatcagtctacaaagctcctcatcgagtctgcttcccagccccatcgtcaggggtccccctgagttcagtgcagtgatcgngggactgattcaccctnaccatcagtcgcctggaacctgaagntgctgaccaanatattacngtacaacagagtagtnacctccaacctcactacgtttcgggaccgaagggggtacccaaaggcctaggggaaaactacgtaaccgaaaacgtcgtcggtaacgtactacgacctaaccgtactccgttacgtacc

SEQ ID NO: 306416 - DNA, 539 bp, Homo sapiens
  misc_feature: GZ8MTXP02JTST8.25.39.D06.1.454.CMB.2.raw
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcggagcattggtactaattacactggtaccagacaaaaaccaaatcagtctaccaaagctacctcatcgagtctgccttcccagcccatgtcacggggtcccctgagttcagtcggcagtcgatcgtgggacngatttccaccctnaccatcagtcgcctggaacctgaagntgctgacaatattattacntacaacgagagtacgtcncctaccactcacgttacgtttacggaccgaacgggtaccaggtcgtaggacgtaactaacgaaacgtacgtcggtcgctacgaccacctacgttcgtacgttc

SEQ ID NO: 306417 - DNA, 706 bp, Homo sapiens
  misc_feature: GZ8MTXP02I9ZPQ.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtcgtccggggaacagccaccctctcctgcagggccgcagactgtgacaacgacttagcctggtaccaacagaagcctggccaggcctcccgaggcctcctcatctatgatacttccagtacggccagtggcactcccagccccgcttcgaggtcggcccgtaggtcggggtctaggggactaggtacgtttacctctaccaacctacttccctaccgaacggtccccttaaaggaccgtcccgttaaggtaaacgtttagttttttacgggacctttaaaggtttttaactttaacgttcggttaccgaacgtccgttaccccgaagaaaacggtaacggtccggtacccttaccctaaaagttacttaccgtaaccggttttcccggacccgttaaggggtaaacccaaaaggttccggtaaaattaactaaaccgaaaaacggtaaccgttggttacggacttacggaaccctaacccgtaattccgttacgttcctttaccgaactttcccccg

SEQ ID NO: 306418 - DNA, 584 bp, Homo sapiens
  misc_feature: GZ8MTXP02HIEIN.25.39.D06.1.454.CMB.2.raw
  modified_base (262)..(262): a, c, t, g, unknown or other
  misc_feature (262)..(262): n is a, c, g, or t
  modified_base (335)..(335): a, c, t, g, unknown or other
  misc_feature (335)..(335): n is a, c, g, or t
  modified_base (368)..(368): a, c, t, g, unknown or other
  misc_feature (368)..(368): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacgagccaccctctcctgcagggccggccagactgttgacaacgacttagcctggtaccaanagaagcctggccaggcctcccaggcctcctcatctatgataccttccagtaggccatggcatccccagccccnttcagtgccagtggtctggggacagagtttccnctcacctatcctccagcctagagcctagaacgtatttgctagtttatactgtcagtctaccgacgaagtaagtcggacctacccaattacttaccgtacgtttccggtcccgtacggggtaaccaaaaggttcggaaattacgtaaccgtaaaacggaccttagggtacgtctggaaccgacctaacgtccttagtcccttactaacgtttccccg

SEQ ID NO: 306419 - DNA, 757 bp, Homo sapiens
  misc_feature: GZ8MTXP02HJV1W.25.39.D06.1.454.CMB.2.raw
  modified_base (150)..(150): a, c, t, g, unknown or other
  misc_feature (150)..(150): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtnaaattatgctgactcagtctccagtactttcagtctgtcgactaccaaaggcgaaagtccaccatccaccgtggccgggctggtcggagctagttggtaacttaattacactcggtaaccaagaaccaaaaaccaatcagtacctaccaaagcctcctcatcgagtcctcgccttcccacgcccagttcgtccggaccggggtcccctggtaggttcgaggtccggctaggtcgactcgagggactgtaccttccacccctcacctagtcgacggtccgtaccgtacggtaacccgtaggaaacgtacgtcggtaccgtaacgtaacctaaacgttaacttaacgtttaaccgtaccgttaaacgaaaaccgttaaagggtaacgggttaccgttacccgtaccccttaccccgttaacccttacccgtttaaacccgtttacccgggttttacccgggggaaacccggggttaaaccgggggaaacccgttaacgggtaccggtaaacgggaaacgtaaaccgttaaacccgaaaaccggttacggttcggtaacgggaccttaaccggacccttaaaccgttactttccggtttacgtttacccc

SEQ ID NO: 306420 - DNA, 714 bp, Homo sapiens
  misc_feature: GZ8MTXP02I7IBZ.25.39.D06.1.454.CMB.2.raw
tcagactgtacagtcacgaccggtgctcgatttagtgacatctcgcagttctttgggggaggaactgctcagttaggactcagagggaaccatggaagccccagctcagcttctcttcctcctgctactctggctcccagattccagcggcgaaactgtgttgacacagtctccagccaccctgtctttgtcgtccgggggaacacgcccaccctctcctgcgagggccggcagactgttgacaacgacttagcctggtaaccaacgagaacgcctggccaggcctcccgaggcctccctcatcctatgaattacctttccaggtacggccctaacgtggcccactccccacggtccccgtcttaccgaggtcgggccgtaggttcggggtcgtaggggaccaggttcgtttacctcctaccacctattccctacccgacgtacccgttacggacgtacccgtggtaaagttagtttttcggcctttaaggttttactttaaccgttgttactacggtcccttaccggacgtaaaggtaacggtacgggtaccctaccgtaaacttacgtttacctaaccgtttcccggtacccgttaccggggtaaacccgtaaaacgggttacggtaataaacgtaaaccgtaaaacgtaaaccgtaggttacggtctaaccggacctaaccgtacgttcttacggttccttaccgttaccc

SEQ ID NO: 306421 - DNA, 592 bp, Homo sapiens
  misc_feature: GZ8MTXP02GKL6W.25.39.D06.1.454.CMB.2.raw
  modified_base (150)..(150): a, c, t, g, unknown or other
  misc_feature (150)..(150): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtnaaattatgctgactcagtctccagactttcagtctgtgactccaaaggcaaagtcaccatcactgccggcagtcgagcattggtactaattacactggtaccagacaaaaacaatcagtctaccaaagcctctcatcgagtctcgccttcccagccccagtcgtaccgacggggttccccctaggaggttccaggtcggacctaggtggattcgtggggaactaggtactttacccacccctcaacctatccaggtcggaccctaggaaaccctggaaagattcgcctagacctaaactattacttactacgtacaaaacgtgaagttacgcgaccctccaaccttacaacttcgtttacgggaccgaacggggacccaaggcgtagggaactacgtacgaaaaacgtcgtggcggactcgactactactcgttcgttaccc

SEQ ID NO: 306422 - DNA, 728 bp, Homo sapiens
  misc_feature: GZ8MTXP02GQPTC.25.39.D06.1.454.CMB.2.raw
  modified_base (366)..(366): a, c, t, g, unknown or other
  misc_feature (366)..(366): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacacgcccaccctctcctgcgacgggccggccagactgttacgacaacgtacttagcctaggtacccaagaggaacgccgtggcccaggcctcccgagcctcctcatcctatgactaccttccgaggtacggccacgtcggacctaccgtccccacggccccgtnttaccgaggttcggcccgtagggtcgggtcgtacggggtactaaggttacgtttaccgtcctacctaaccctaatttcccccgtaccgaccggtaccccgttaaaggacccgttacccgtaaggtaacgtttaaacgtttttccggaatttaaccggttttaattacccgtaggttaccaacgttccgtaaccggaacgtaaacggtacgttaccggacccttaactaaactttacgttaccgtaccggttttccccggaccgttaacggggaaaacgtaacgtaggtaactaaactaaacgaaaacgggtcttaggacggtcacgccaacgtacttccgttcttaccttacctctttcccg

SEQ ID NO: 306423 - DNA, 554 bp, Homo sapiens
  misc_feature: GZ8MTXP02IIV57.25.39.D06.1.454.CMB.2.raw
  modified_base (421)..(421): a, c, t, g, unknown or other
  misc_feature (421)..(421): n is a, c, g, or t
  modified_base (450)..(450): a, c, t, g, unknown or other
  misc_feature (450)..(450): n is a, c, g, or t
  modified_base (467)..(467): a, c, t, g, unknown or other
  misc_feature (467)..(467): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtccgtccgggggaacagccaccctctcctgcagggccgcagactgttgacacgacttagcctggtaccaacagaagcctggccaggcctcccaggcctcctcatctatgatacttccagtacggccatggcactccccagccccgtcttcgaggttcggccctaggtcggggtctaggggactaggtacgtttctctcaccctatcctcagtccctagagcctagaagtntttgcttagtttatactgtcagctccganagtagtcgacctacatnttacactttcgcctaggacctaaagtcgatatacgaaaacgacgtgtacgctagcctaaacctcttactcgttacttactactcccg

SEQ ID NO: 306424 - DNA, 556 bp, Homo sapiens
  misc_feature: GZ8MTXP02FX53M.25.39.D06.1.454.CMB.2.raw
  modified_base (231)..(231): a, c, t, g, unknown or other
  misc_feature (231)..(231): n is a, c, g, or t
  modified_base (355)..(355): a, c, t, g, unknown or other
  misc_feature (355)..(355): n is a, c, g, or t
  modified_base (401)..(401): a, c, t, g, unknown or other
  misc_feature (401)..(401): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccgaggggtgaaattatgctgactcagtctccagactttcagtctgtgactccaaaggcaaagtcaccatcacctgccggcagtcggancattggtactaattacactggtaccagacaaaaccaatcagtctaccaagcctcctcatcgagtctgccttcccagccccatcgtccgacggggtccccctggagttcagtcggcagtgatcgnggactgtacttcaccctcacctatcagtcgcctaggaacctgaagntgctagactaacatacttactagtacaacgagtacgtagtcaccctacctacctactaaccttacgttcggaccgtaacggggtaccaaggcgtaggacgtaactaccgaaaacgtcgaggtaacgcttacgacctacctacttcctacgttacc

SEQ ID NO: 306425 - DNA, 523 bp, Homo sapiens
  misc_feature: GZ8MTXP02JOQF7.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgtgacaacgcttagcctggtaccaacagaagcctggccaggctcccaggcctcctcatctatgatacttccaggtaggccagtggcactcccagccctcttcagtggccaggtggtctgggacagtatttcgctcaccatcctccagtcctagacgcctagaagtatttgactagtttattactgtcagctcgacaagagtcgcctacaattactctacttcgcctacgggacaagtgatatacgaaacgactgtcgctacgcaccattccgtattcctacactttcccg

SEQ ID NO: 306426 - DNA, 559 bp, Homo sapiens
  misc_feature: GZ8MTXP02HF24Y.25.39.D06.1.454.CMB.2.raw
  modified_base (151)..(151): a, c, t, g, unknown or other
  misc_feature (151)..(151): n is a, c, g, or t
  modified_base (233)..(233): a, c, t, g, unknown or other
  misc_feature (233)..(233): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtnaaattatgctgactcagtctccagtactttcagtctgtgactccaaaggcgaaagtcaccatcacctgccgggcagtcggancattggtactaattacactggaccaagacaaaaaccaatcatctaccaaagctcctcatcgagtctgccttcccagccccatcgtccgacggggtccccctggaggttcaggtcggcaggtggatcgtagggactggtactttcacccctcacctatcgagtcggcctaggaacctggaagtatcggctagacaaactattattactagtacaaacgagtagtagtcgacctccacctcaacttacgtttcggacgaacggggtaccaaggcgtagggacaactacgaaaaccgtagtgtcggctcgaccaacctgttctacgttc

SEQ ID NO: 306427 - DNA, 571 bp, Homo sapiens
  misc_feature: GZ8MTXP02I2323.25.39.D06.1.454.CMB.2.raw
  modified_base (230)..(230): a, c, t, g, unknown or other
  misc_feature (230)..(230): n is a, c, g, or t
  modified_base (423)..(423): a, c, t, g, unknown or other
  misc_feature (423)..(423): n is a, c, g, or t
tcagactgtacagtcacgaccggtgctcgatttagtgacatctcgcagttctttggggggcatgaacaaaactgacaagtcaaggcaggaagatgttgccatcacaactcattgggtttctgctgctctgggttccagcctccaggggtgaaattatgctgactcagtctccagtactttcagtctgtgactccaaaggcgaaagtcacatcacctgccggcagtcggancattggtactaattacactggtaccagacaaaaaccatcagtctaccaaagcctctcatcgagtctgccttacccagcccctagtcgtaccgacggggtcccctggtacggttcaggtcggcctaggtggactcggtagggacctagtctttccacccctcacccatcgaggtcggcctaggaacctgaacgntgctgactaatattattactgtacaacgagtagtacgtcgtacctaccacctactacgttacgtttcggaccgtacggggtaccaaggtcgtaggacgtactaacgaaacgacgtgtacggctcgacactgttacctcgttacttacg

SEQ ID NO: 306428 - DNA, 573 bp, Homo sapiens
  misc_feature: GZ8MTXP02GLIAQ.25.39.D06.1.454.CMB.2.raw
  modified_base (333)..(333): a, c, t, g, unknown or other
  misc_feature (333)..(333): n is a, c, g, or t
  modified_base (414)..(414): a, c, t, g, unknown or other
  misc_feature (414)..(414): n is a, c, g, or t
  modified_base (559)..(559): a, c, t, g, unknown or other
  misc_feature (559)..(559): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacgagccacctctcctgcagggccgcagactgtgacaacgacttagcctggtaccaacagaacgcctggccaggcctccaggcctcctcatctatgatactccagtacggccactggcactcccagcccctnttcaggtcgccaggtggtctggacagtagtttactctacactactcctaccgacgtccctaagacgtaccctagaaagttnttttagactagtttattaacgtgtacagtcctacgactaagaagtcggaccttacaattacttactacctttcggcccgtaggtaaccgtaaaggtgtacttaataacgaaaacgtacgtagtcggactgaacctacgactcgtntactctacttcccg

SEQ ID NO: 306429 - DNA, 574 bp, Homo sapiens
  misc_feature: GZ8MTXP02JAVE6.25.39.D06.1.454.CMB.2.raw
  modified_base (229)..(229): a, c, t, g, unknown or other
  misc_feature (229)..(229): n is a, c, g, or t
  modified_base (281)..(281): a, c, t, g, unknown or other
  misc_feature (281)..(281): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccaggggtgaaattatgctgactcagtctccagtactttcagtctgtgactccaaaggcgaagtcacatcacctgccggcagtcgancattgtactaattacactggtaccagacaaaaccatcagtctacaagctctnatcgatctgccttacccagcccatcgcgtaccggggtcccctggtacgttcgagtcggcagtgactcgtggacngtcttcaccctnacctatcgagtcgaccgtacgaccgtagaanatcgctagactaaactattagttaccagtacaaacgagtaggtagtcgtacctaccacctactaacgttacgtttacggacccgtaacggggaccaggtccgtaacgggaacgtaaacgtaccgaaaacggtaacgttcggaaggtacctcgacccacctagttcctcgtttaccc

SEQ ID NO: 306430 - DNA, 533 bp, Homo sapiens
  misc_feature: GZ8MTXP02IQ0QB.25.39.D06.1.454.CMB.2.raw
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgcagactgttgacaacgacttagcctggtaaccaacagaagcctggccaggctcccaggctcctcatctatnatacttccagtaggccactggcatcccagcccgcttcagtggccagtgggtctggggacagagtttacnctacacatcncanctangctagaatatttgatagtttatactgtcacgactcgacaagaagtacgacctacctaactattactacttcgtccgtacgaacgaaacgtaacgataataacaaacgaaacgtacgtacgacgtacgaacacactactactctactactc

SEQ ID NO: 306431 - DNA, 593 bp, Homo sapiens
  misc_feature: GZ8MTXP02GLKO4.25.39.D06.1.454.CMB.2.raw
  modified_base (151)..(151): a, c, t, g, unknown or other
  misc_feature (151)..(151): n is a, c, g, or t
  modified_base (233)..(233): a, c, t, g, unknown or other
  misc_feature (233)..(233): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtnaaattatgctgactcagtctccagactttcagtctgtgactaccaaaggcgaaagtcaccatccacctgccggcagtcgganctattggtaactaattacactggtaccagacaaaaaccaatcagtctacaaagctcctanatcgagtctgccttcccagcccatcgtcgacggggtcccctggagttcagtcgcagtgatcgnggacngacttcaaccctcacctatcgagtcgcctaggaacctagaagatcgctagaccaatatacttaactgtacaaacgagagttacggtcgaccttaccaaccctctaacgttacgtttacgggacccgtaacgggggaacccaaaaggtcgtaggggaacgtaaactaaccgaaaaacggtaccgttaggtaacgggtcctaacggaccaacccgtaattccgttacgtttccc

SEQ ID NO: 306432 - DNA, 590 bp, Homo sapiens
  misc_feature: GZ8MTXP02G0BEI.25.39.D06.1.454.CMB.2.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccggggaacagccaccctctcctgcagggccgccagactgtgacaacgacttagcctggtaccaanagaancctggccaggctccaggctcctcatctatgatacttccagtacggccacgtggcatcccagccccgnttcagtcgccaggtgggtctggggacaggtagtttacncgtacaccatcctcgacgcctagacgacctagaagtatttgactagtttattactgtcagcctcgacgaagtagtcgcctacaacttattacctacgtttccgggacccctagggtaaacccgtaaaggtacggtaattactaaccgtaaaacgtaacgttacggtacggtcttaggaacccgtaaccaacttcctcggtttaccttacctaactttccccg

SEQ ID NO: 306433 - DNA, 616 bp, Homo sapiens
  misc_feature: GZ8MTXP02JQJCC.25.39.D06.1.454.CMB.2.raw
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtctttgtcgtccggggaacagccaccctctcctgcacgggccggccagactgttgacaacgacttagcctaggtaccaacagaacgcctggccaggcctcccaggcctcctcatctatgactcttccaggtacggccacgtggcactcccagccccgtnttcgaggtcgccgaggtgggtctggggacaggtacgtttcncgtctaccacttctacccgagtcccgtaagcgtacctagaagttattttcgacttagtttacttacgtagtctacgtcctaccgacaaaggtaagtcggtacctaactaaattactttacctaccgtttcccgggacccttaggggaacctaaaaggtcggaatataaccgaaaacgacgttggtacggccctagaacctacgtacttacgtcttaccttactacctttcccg

SEQ ID NO: 306434 - DNA, 611 bp, Homo sapiens
  misc_feature: GZ8MTXP02GQY6Q.25.39.D06.1.454.CMB.2.raw
  modified_base (255)..(255): a, c, t, g, unknown or other
  misc_feature (255)..(255): n is a, c, g, or t
  modified_base (399)..(399): a, c, t, g, unknown or other
  misc_feature (399)..(399): n is a, c, g, or t
tcagactgtacagtcacgaccggtgctcgatttagtgacatctcgcagttctttgggggaggaactgctcagttaggacccagacggaaccatggaagccccagcgcagcttctcttcctcctgctactctggctcccagatgccactggagaaattgtgatgacgcagtctccagcctcctgtctgtgtctccgtggggaagcgccacctctcctgcagggccagtcagagcgttggcaggacttgctggaccngcagaacctggccagccctccagtaccctcctcctcttatcggtctccttcccaccgacgggtccccctagactaccgtccccgctaggttcacggtcgcgtaggtcggggtctagggacaggtacgttcacctctaccaactntcgagcacgtcccgtgacctagttctaggaacgtttagtttgactttaagtttaacttcgttacgtacctaaacgtaagttaactaaataaccgtcgtacccgttcgtagggttaccggtttcgaacgtaacggtaccgaaagggtaggaaaacgtaacgaaacggtaacgtcggacgtacgtcgacaacgtctactcgttacctacgtacc

SEQ ID NO: 306435 - DNA, 567 bp, Homo sapiens
  misc_feature: GZ8MTXP02GEYYT.25.39.D06.1.454.CMB.2.raw
  modified_base (330)..(330): a, c, t, g, unknown or other
  misc_feature (330)..(330): n is a, c, g, or t
  modified_base (457)..(457): a, c, t, g, unknown or other
  misc_feature (457)..(457): n is a, c, g, or t
  modified_base (555)..(555): a, c, t, g, unknown or other
  misc_feature (555)..(555): n is a, c, g, or t
tcagactgtacagtcacgaccggtgctcgatttagtgacatctcgcagttctttgggggaggaactgctcagttaggacccagagggaaccatggaagcccccagctcagcttctcttcctcctgctactctggctcccagattccagcggcgaaactgtgttgacacagtctccagccaccctgtctttgtcgtccggggaacagccaccctctcctgcaggccgccagactgttgacacgacttagcctggtaccaacagaacgcctggccaggcctcccaggcctcctcatctatgatactcagtaggccatggcatcccagcccgnttccgagtggccaggtggtctggggaccaggttagtttctctccaaccatcctcccagccctagagtccctagaagtatttttgacctaaggtttttacttaacttgttacagtccttcccggaaanaacgtacgtccgtacctactaattctacctacgttccgaccgtaggaactaagtcgactacgacgaacgtacgtcgtacgcacgaacctactactctntctctacttccc

SEQ ID NO: 306436 - DNA, 555 bp, Homo sapiens
  misc_feature: GZ8MTXP02HLODI.25.39.D06.1.454.CMB.2.raw
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
  modified_base (451)..(451): a, c, t, g, unknown or other
  misc_feature (451)..(451): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtctccggggaacagccaccctctcctgcagggccgccagactgttgacaacgacttagcctggtaccaacagaagcctggccaggccncccaggctccncatctatgatacttccagtacggccatggcactcccagccccgnttcgagtgcctaggtggtcctggggacaggtagtttacctctacacctatcctaccagtccctaagactcctagaaacgtattttagcttaagttttattacgtgtacagtcctccganaagtaagcggcctaccaattacttacactttcgccgtagggaacaaagtgatatacaaacggtaactcgacggctacgaacacaatctagtcctactactcccg

SEQ ID NO: 306437 - DNA, 527 bp, Homo sapiens
  misc_feature: GZ8MTXP02GUI9J.25.39.D06.1.454.CMB.2.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (293)..(294): a, c, t, g, unknown or other
  misc_feature (293)..(294): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaaactgtgttgacacagtctccagccaccctgtctttgtctccgggggaacagccaccctctcctgcagggccggccagactgttgacaacgacttagcctggtaccaaanagaagcctgcagcnccagctctcatctannatactcagaggcactgcanccacgccgctcagtgcgagtggtcgtggagagagttactctcacactctcacncacagcncagtattatntatattatatatnatcacacgaagaagtacgactactactactactactactacgtacgtacgtacgaacgaacgtaacgtaaacgtaaacgtaacgtaacgtaacgtaacgtaacgtacgtacgtacgtactactactactac

SEQ ID NO: 306438 - DNA, 744 bp, Homo sapiens
  misc_feature: GZ8MTXP02JUE09.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacgacgccaccctctcctgcgagggccggccagactgttgacaacgacttagcctggtaaccaacagaacgcctggccaggcctcccaggcctcctcactctatgactaccttccaaggtacgggccacgtcggcactcccgacgcccgtcttcgagtcggccgaggtgggtcgtaggggactaggtacgtttactccgtacacctatccctccgaacgtcccgtaagacgtaccctaggtaaaacgttagtttttacgactttaaggttttaactttacgttacgttaccgtaacgtacccgttacccggaaacgtaaacgggttaaacggttccgggtacccttaacccgttaaaactttaccgtttacccgttaaccggtttttccccggggacccgttaacgggggtaaaaccctaaaagggtttacgggtaaacttaaacgtaaaccgtaaaaaccggtaacgttaacgggtcggtaccgttacggaaccctaaccgtaacgttccttacggtttacctttccgttaacctttccccg

SEQ ID NO: 306439 - DNA, 543 bp, Homo sapiens
  misc_feature: GZ8MTXP02FXI5M.25.39.D06.1.454.CMB.2.raw
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagactgtacagtcacgaccggtgctcgatttagtgacatctcgcagttctttgggggaggaactgctcagttaggacccagagggaaccatggaagcccccagctcagcttctcttcctcctgctactctggctcccagattccagcggcgaaactgtgttgacacagtctccagccaccctgtctttgtcctccgggggaacagccaccctctcctgcagggccgccagactgtgacaagacttagcctggtaccaacagaagcctggccaggcctcccaggcctcctnatctangatactcagtaggccatgcactcccagcccgctcagtgccaggtggcngggacagtacgtttcnctacaccgatcagcancctagcacgcctagaacgtatgttacgactaacttaacttactagtaactaaaatttcgaactagtacgaccgtagattcggttcgaccgaggaaccaagggtacgaacgatacaaaacgaactagtcgactcgacaacgctactcgtcttacacttcctacccg

SEQ ID NO: 306440 - DNA, 681 bp, Homo sapiens
  misc_feature: GZ8MTXP02F0WNP.25.39.D06.1.454.CMB.2.raw
  modified_base (344)..(344): a, c, t, g, unknown or other
  misc_feature (344)..(344): n is a, c, g, or t
  modified_base (388)..(388): a, c, t, g, unknown or other
  misc_feature (388)..(388): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacagccaccctctcctgcagggccggcagactgttgacaacgacttagcctaggtaccaacagaacgcctggccaggcctccaggcctcctcatctatgataccttcagtacggcccactacgccaactccccagcccccgtnttccgaggtggccctaggtcgggtctggggacagttacgtttcncctacacctactcctccacgtcccgtagacgcccgtagaaacgttgttttcgtacgttaagtttttattaacgttgtaccagtcctccgacaaaggtaacgtccggtaccctacgtaaacttactttacctacgttttcccggacccgttacgggaaaaccctaaggttacggtaacttaactaaaccgtaaaaaccgtaacgttacgggttaaccggccgtttaacgaacccgttaaaaccccgttacgtttacccgttacgtttacccgtttaccttaccgtttacccccg

SEQ ID NO: 306441 - DNA, 779 bp, Homo sapiens
  misc_feature: GZ8MTXP02FJ3IF.25.39.D06.1.454.CMB.2.raw
  modified_base (340)..(340): a, c, t, g, unknown or other
  misc_feature (340)..(340): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacaaagtctccagccaccctgtctttgtctccgggggaacagccaccctctcctgcagggccgccagactgtgacaacgacttagcctggtaaccaacgagaacgcctggccaggcctcccgaggcctcctcatctatgatactccagtacggccacgtggcactcccagccccgtnttcgaggtcggctagggtcgggtcctggggaacctaggtacgttttactccgtaccaacctattccctaccgaaggtcccccgttaaaggaccgtacccgttaaggtaaacggttacttttttacggacccgttttaaaggttttaactttaaccgttacggtttaccgaacggttacccgttacccggaacgtaaaacgggtaaacggttccgggtaccccctttaaaccgtaaagtttaccctttaccgttaaccccgtttttacccgggggacccccggtttaacgggggaaaacccccgttaaaaggggttacgggtaaaacttaaaccggtaaacccggtaaaaaccggtaaaccgttggttacggggtacttaccggaccctaaaccgtcttacgtcggttacctttacccgactttcccccgtttacccccg

SEQ ID NO: 306442 - DNA, 643 bp, Homo sapiens
  misc_feature: GZ8MTXP02HIIHW.25.39.D06.1.454.CMB.2.raw
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtctccggggaacgagccaccctctcctgcagggccgcagactgtgacaacgacttagcctggtaccaacagaacgcctggccaggcctcccgaggcctcctcatctatgatacttcagtcggccatggcactcccagccccgtnttcgagtgcctaggtcggtcgtgggactaggtagtttccnctacacctactcctcacgtccctagacgcctagacgtnttttgcttagtttacttacgtgtactacgtccttcccggaagaaacggtaacggtcggtacccttaacctaaatttacctttaccgtaaccgttttcccggggaccccgttaaggggaaaacccgtaaaaggttcgggtaaacttaaacgtaaccgaaaaaccgttaacgtcgggtacggtcttacgaaccctaacctaacgttctacgtttccttacttaccgtttccccc

SEQ ID NO: 306443 - DNA, 521 bp, Homo sapiens
  misc_feature: GZ8MTXP02JNDLM.25.39.D06.1.454.CMB.2.raw
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggcctcctcatctatgatacttccagtacgggccactggcatcccagccccgnttcattggcccagtgggtctggggacaggtagtttcnctcaccctatcctccagccctagancctgaatatttgctagtttattactgtcagtctcgacaagaagtcggcctacaatctactactttcggccctggaccaaagtcgatatacaaacgactgtcgctgcacatctgtcttcactcc

SEQ ID NO: 306444 - DNA, 692 bp, Homo sapiens
  misc_feature: GZ8MTXP02JMLH9.25.39.D06.1.454.CMB.2.raw
  modified_base (316)..(316): a, c, t, g, unknown or other
  misc_feature (316)..(316): n is a, c, g, or t
  modified_base (610)..(610): a, c, t, g, unknown or other
  misc_feature (610)..(610): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgtttattttccaggtgtccagagtgaggtgcaggttggtggagtcgtgggggagtcttggtccagccgtgggagggttccgtgagagtctctgtgcagcctgtgattcattctcagtcaccactacagtggacgtcggggtcccnccgaggcctacccggaagggggtaacggggtcgttaggggaggttgggggttcggaccgttaaagtttaaaggaaaaagtaaacgtacgttaaaaggacgttaaccaccgaaacaaaggtaaacgtaccgcccggtacgtctagggtaacggaaaggcctaaggtactttactaatttactaccgtaagaaaggtagtagttagtaaactttaacgaaaaacgtaacttactaacgttggttaactcgttagaactaaaagtacgaaacacgtaaccgtaacggaaaaaccggnggaaaccgacgggtaccgttagttacgttacgtgtacggcgttacggtaccgagtacgttacggtactaacctttaaccccg

SEQ ID NO: 306445 - DNA, 717 bp, Homo sapiens
  misc_feature: GZ8MTXP02HMVIW.25.39.D06.1.454.CMB.2.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
tcagactgtacagtcacgaccggtgctcgatttagtgacatctcgcagttctttggggagctgtgggcttaggaagcagagcctggggcatctccaccatggcctggacccctctcctcctccagcttctcaccctctgctcagggtcctgggcacagtctgcgctcgacccaggaagacgtcggtggtcggggaccgtgggacagaaagtcacctgtcttgttctggtacgagcgaacaactattaggaactatccgtggtggctggtaccaanagaatgtcaccggtacccccaaatgngatgtcgtggagtntcgttcccgccgtcgacgggactcccgtcgccctcttacgtcgtggtacngtgtcgtcgggacacacgccctcccgtagaactcgtccggccggtccacgacggccgtaggacggacgacggtccgttcgggtactaccgtgccgtacgagtacctaggtcgggtaccttcgttggaccgttcgtacccgtgttaccggtccgtaacgggtaccggggtttccgggttcccggggggtaacccggggggtccccgggtttacgggtacccccggttaccggtttacggggacccgtaaccggaccccgaacgggtccccgtttaaccccggccccccggttaccgggtcccgtaaccctttcccgttccccggtttaaccccccgttacccccgttttcccg

SEQ ID NO: 306446 - DNA, 781 bp, Homo sapiens
  misc_feature: GZ8MTXP02IE882.25.39.D06.1.454.CMB.2.raw
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccgaggggtgaaattatgctgactcagtctccagtactttcagtctgtgactaccgaaaggcgaaagtccaaccatccacctggccgggcaggtcggagctagttggtaactaattacactggaacccaagaaccaaaaaaccaatcaagtacctaccaaagcctaccacatcgagttctcgcccttacccagtcccatcggtaccgtaccggggtccccctaggtaggttaccaggtcccggacgtaaggtgggtactcgggtaggggtaactacggttaactttccccgaaaccccccttcgaaacccgtagttaccgtaacgggttaccggacccggtaacggggtaaaaccctgggtaaaaggtacgttacggaccttacggaaccctaaaagtactttaaacgtttaaaccgtacggtaaaccctaaaaggtaacggtaagggtttaccgacccggtaccctacccccgtaaccttaccctaaaccgtttaaccggttttcggggaaaccccgaaaacgggggtaccaaaacgggttccgtaaagggaaccgtaaacgttaaaccggaaaacggttaccgtcgggtaacggtcctaaccggaccctaaccttacggttccgtttacgtttcccg

SEQ ID NO: 306447 - DNA, 535 bp, Homo sapiens
  misc_feature: GZ8MTXP02F3KQ0.25.39.D06.1.454.CMB.2.raw
  modified_base (262)..(262): a, c, t, g, unknown or other
  misc_feature (262)..(262): n is a, c, g, or t
  modified_base (367)..(367): a, c, t, g, unknown or other
  misc_feature (367)..(367): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaanagaagcctggccaggctcccaggctcctcatctatgatacttccagtaggccatggcatcccagcccgcttcagtggccagtgggtctggggacaggtagtttcnctcaccatcctcagccctagcgcctgaagtatttgctagtttattactgtcagtctccgacaagaagtcggacctacctaatacttactacgtttcggcccgtaggaacctaaagtacggatatacaaacgaacgtgacggctgcacactctcgtcttcactttcccg

SEQ ID NO: 306448 - DNA, 601 bp, Homo sapiens
  misc_feature: GZ8MTXP02ICLSR.25.39.D06.1.454.CMB.2.raw
  modified_base (333)..(333): a, c, t, g, unknown or other
  misc_feature (333)..(333): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccgccagactgttgacaacgacttagcctggtacccaacagaagcctggcccaggcctccaggctcctcatctatgatacttcagtaggccatggcactcccagccccnttcagtggcccaggtgggtctggggactaggtagtttctctcaacctatccctacacgtcctagagaccctagaagtattttgacgttagtttattacgttgtcacgtacctccgaacgtaaaggtaagtcgggtaccctacctaaattacctttctaacgtttccggacccgttacggggaaaccctaaaaggttacggattaacgtaccgtaaaacgtaaacgtggtacggtcttcgaacacctactcttgtccttacactttccc

SEQ ID NO: 306449 - DNA, 840 bp, Homo sapiens
  misc_feature: GZ8MTXP02IKPKW.25.39.D06.1.454.CMB.2.raw
tcagactgtacagtcacgaccggtgctcgatttagtgacatctcgcagttctttgggggcatgagcaaaactgacaagtcaaggcaggaagatgttgccatcacaactcattgggtttctgctgctctgggttccagcctccagggtgaaattatgctgactcagtctccagacttttcagtctgtgactccaaaggcgaaagtcaccatcaccgtgccgggccaggtcggagcagtttcggtaactaatttacacgtggtacccagacaaaaaccaatcaagtcctaccaaagtcctacctacaatccgagttcctcgcctttacccccaaggtcccccaagtttcgggtccgaacgggggttcccccccttacggtaggtttcccgaagggttcccgggactaaggttcgggacttccggttagggggaacctagggttacctttttacccaaaccccccttcgaaaccccctattacccggtaaggtcccggggtacccacggggtaaaacccttaggaaaggtaacgttcgggaccttaacggaacctaaaaccgttagtttaaacttaacccggttagttaaacccgaaaaacggttaggtaaacgttttaaccggggtaaccctaccccgttaacccccgtaaacctttaaccgttaacccgtttaacccgggttttacggggaaccccggtaaaacgggggtaaccctaaaacgggtccgttaaacgggtaaaaccgttaaaaccgtaaacccggtaaaaaccgttacgtacgggtaaccgggttactaaaccggtaccctaaaccgtttaccgtttaccgtttaccgtaccg

SEQ ID NO: 306450 - DNA, 522 bp, Homo sapiens
  misc_feature: GZ8MTXP02F9MD1.25.39.D06.1.454.CMB.2.raw
  modified_base (150)..(150): a, c, t, g, unknown or other
  misc_feature (150)..(150): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcatccaggggtnaaattatgctgactcagtctccagtactttcagtctgtgactccaaaggcgaaagtcaccatcacctgccggcagtcgancatgtactattcatgacanacaaaacatcagtctacaagctctnatcgatctgcctccagcccatcgtccgacggggtcccctggacggttcaggtgcaggtggatcgngggcagtcttccaccctnacctntcagtcggacctaggaacctaggaagacgtgctagacaactattaacttacaggtacaacgagtagtagcncctccactctactacgtttcggaccgtacgggacctaagcgtaggacgactacgaaacgtacgtggtacggctacgacacctatcttac

SEQ ID NO: 306451 - DNA, 598 bp, Homo sapiens
  misc_feature: GZ8MTXP02GDXZN.25.39.D06.1.454.CMB.2.raw
  modified_base (151)..(151): a, c, t, g, unknown or other
  misc_feature (151)..(151): n is a, c, g, or t
  modified_base (182)..(182): a, c, t, g, unknown or other
  misc_feature (182)..(182): n is a, c, g, or t
  modified_base (297)..(297): a, c, t, g, unknown or other
  misc_feature (297)..(297): n is a, c, g, or t
  modified_base (519)..(519): a, c, t, g, unknown or other
  misc_feature (519)..(519): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtnaaattatgctgactcagtctccagtactttnagtctgtgactaccaaaggcaaagtcaccatcaccgtgccgggcaggtcgagctattggtaactaattacactggtaccaagaacaaaaacaatcagtactaccaaagcctactnatcgatctgcctcccagcccatcgtacccgacggggtccccctaggagttcagtcggcagtggatcgtgggactgtacttcaaccctcaccatcgagtcgacctaggaacctagaagtatgacctagaacaaacattactttaacagtaacaaacgtagagttaaggtcaccctaccacctactaacgtacgtttacggaccgaaggggaccaaaacgggtnaacgggaagtaaactaaccgaaaaaccgtacggttcggtaaggctacgtacccaaaccgtagttccttcggtttaaccc

SEQ ID NO: 306452 - DNA, 600 bp, Homo sapiens
  misc_feature: GZ8MTXP02IODYA.25.39.D06.1.454.CMB.2.raw
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (492)..(492): a, c, t, g, unknown or other
  misc_feature (492)..(492): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtgaaattatgctgactcagtctccagtactttcagtctgtgactccaaaggcaaagtcaccatcacctgccggcagtcggagcattggtactaattacactggaccagaacaaaaccaatcagtcacaaagcctccnatcgagtcngccttccccagccccagtcgtccgacggggtccccctaggtacggttcaggtcggactaggtcggatcggtagggactgtactttcccaaccccttcaacccgtataccgaggtccggacccgtaggaaaccctaggaaagtagtcgactagaaccctaaatattacttaactgtaaccaaagtagaagtaggtacncctacccacctactactacgtttcggaccgaacggggtaccaaggcgtacggaaatacgtaaccgaaacgtacgtggtcggactcgacctacctagttcttcgttacc

SEQ ID NO: 306453 - DNA, 558 bp, Homo sapiens
  misc_feature: GZ8MTXP02JY4NI.25.39.D06.1.454.CMB.2.raw
  modified_base (297)..(297): a, c, t, g, unknown or other
  misc_feature (297)..(297): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagactgtacagtcacgaccggtgctcgatttagtgacatctcgcagttctttgggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggtggagtcgtggggggagcttgggtccagccgtgggagggtcctgagagtctctgtgcagcctctggattcatcttcagtcgaccactanagtgacgtggtccgccaggcgtccgagggaggggctgggagtggggtgccgtattagaaataagactagagttacacacaagaatacgcgcgtntagtagaaggacngattcattancgttcaagtagatagattaacaaagaactacactagtactacttagacaagtagacagacctaaggaaaccggtaagaccgacgggacttacgtacgttacagttcgaacgtaggtacgacgacgtacggtcgtacttaacccc

SEQ ID NO: 306454 - DNA, 712 bp, Homo sapiens
  misc_feature: GZ8MTXP02H2KND.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccacctgtcttgtcgtccggggaacgagccaccctctcctgcagggccgcagactgtgacaacgacttagcctggtaccaacagaacgcctggccaggcctcccgaggcctcctacatcctatgattaccttccgagtacgggccactgggcactcccagccccgcttcgaggtcggccaggttcggggtctaggggtacaggttacgtttacgtctacacccattacctcccagcccttagacgtacccgtagtaaagttactttttggaacctttaaggttttacttaccgttagtccgtaagtaccgttaccggaacgtaaacggtaaacggttccgggtaccccttaaccgtaaaactttacctttaacccgtttaacccgtttccggggtaacccccggttaacggggaaaaccccgtaaaaggtttccgggaaacttaacgttaaaccgaaaacggttaaaccgtggtacgggtacttaccggaaccaacccgtaatcccgtttacttaccctttcgtaacccgttcccg

SEQ ID NO: 306455 - DNA, 787 bp, Homo sapiens
  misc_feature: GZ8MTXP02GHY3R.25.39.D06.1.454.CMB.2.raw
  modified_base (253)..(253): a, c, t, g, unknown or other
  misc_feature (253)..(253): n is a, c, g, or t
tcagactgtacagtcacgaccggtgctcgatttagtgacatctcgcagttctttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggagcttggtccagccgtggagggtccgtgagngtctcgtgtgcagcctgtggatcatctcagtcgaccactacatggacgtgggtcccgacgaggcctaccggaaggggacggggtccgttagggtagggttggggtttacgggaccgtttaagttaaacggaaaagtaaaacggaccgttaaaaggtaaccggtttaacccacccgaaacgaacggtaaaaccgttacccgtaccccggtacggttaccgtaggtaaacggggaaaacgggcctaaaagttaacgtttaccaaattttactaccgttaaccgaaaaggtaagtaaagttacggtaaactttaaaccgaaaaacggtaaccttaccttaacggttacgttaactccgtaaggaaactaaaacgttaacgaaaaccgaacgtaacccggtaaaacggaaaaaccccggagggaaaccccgtaacggggtaccgtttaacgtttaaacttaccggtaggttagggaaccttaaggggttaccaacgggtaacccgtttaacgggtaccctacccgtttaaaacccccg

SEQ ID NO: 306456 - DNA, 616 bp, Homo sapiens
  misc_feature: GZ8MTXP02I65XT.25.39.D06.1.454.CMB.2.raw
  modified_base (151)..(151): a, c, t, g, unknown or other
  misc_feature (151)..(151): n is a, c, g, or t
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccgaggggtnaaattatctgactcagtctccagtactttcagtctgtgactccaaaggcaaagtcacatcacctgccggcagtcggancattggtactaattcactggtaccagacaaaacaatcagtctacaaagctacctcaatcgagtctagctcccatcccagtcgtcgacggggtcccctggtacgtcagtcggacagggtgactcgtagggacnggtcttccaaccctcacctatccagtcgccgtaggaaacctgaagagtcgacgtgacaactaatattaaccgtagtaaccaaactaagtaggtacgtacgtacctaccctaccgtacctaaccgttaccgtttacggaccggtaacgggtaaccgaacggtacgtacggtaaacgtaaacgtaaacccgaaaacggtaacgtacggtaacggtaccgtaccgtacccgaaccgtacgtaccgtttacgttaaccg

SEQ ID NO: 306457 - DNA, 697 bp, Homo sapiens
  misc_feature: GZ8MTXP02JAQOR.25.39.D06.1.454.CMB.2.raw
  modified_base (345)..(345): a, c, t, g, unknown or other
  misc_feature (345)..(345): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtcgtccggggaacagccaccctctcctgcgagggccgccagactgttgacaacgacttacgcctggtaaccaacagaacgcctggccaggcctcccgaggcctcctcatctatgataccttccgagtacggccactggcactcccacgccccgtnttcagtcggcctaggtgggtctggggacaggttactttctctaccaccacttcctaccgacgcccgtaagacgtaccctaggaaacgttactttttgacttaagttttactttaacgttcgtactacgtaccgttacccggacgtaaacggtaacggtccgggtacccttaaccgttaaactttacctttaccgttaacccgtttttacccgggcccccgttaaggggaaaccctaaaagggtacgggtaacttaaacgttaaccggaaaaaccgtaacgtttcggtacgggtaccttacggaaccgtaccctaagttcccttacggtttcctttaccgtacttttcccccg

SEQ ID NO: 306458 - DNA, 676 bp, Homo sapiens
  misc_feature: GZ8MTXP02IFFI2.25.39.D06.1.454.CMB.2.raw
  modified_base (234)..(234): a, c, t, g, unknown or other
  misc_feature (234)..(234): n is a, c, g, or t
  modified_base (336)..(336): a, c, t, g, unknown or other
  misc_feature (336)..(336): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgctccggggaacagccaccctctcctgcaggccggccagactgtnacaacgacttagcctggtaccaacagaacgcctaggccaggcctcccgaggccctctcatcatgatacttccagtacggccagtggctactcccagccccgnttcacggtgccgaggtgggtctagggactaggttagtttcctcgtacacctactccgtccaaacgtccctagtacgcccttagaacggtatttgaccttaagttttaaccttatacggttcaacgtcgttacccgacgtaaacggtaaaggtcggtaccctaaccctaaattacttaccgtaaccgtttttcccggaacccgttacgggtaaaaccctaaaaggggttacgtaaaacggttactaaacccgttaaaaaccggaaagttttcgggaccgtaccgttacgaaccctaccggtaacttcccttaaggtttccctttacgttaactttcccccg

SEQ ID NO: 306459 - DNA, 598 bp, Homo sapiens
  misc_feature: GZ8MTXP02FGPQK.25.39.D06.1.454.CMB.2.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (448)..(448): a, c, t, g, unknown or other
  misc_feature (448)..(448): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggcagactgttgacaacgacttagcctggtaccacagaagcctggccaggctcccaggcctccncatctatgatacttccaggtaggccactggacatccccaggccccgnttcaggtggcctaggtgggtctggggacnggtaagtttccnctcactatctcagcctagacgtacctagaattatttgactagtttaattacttgtacacgtacctaccganaacggaacgtcgtaccctactaattacttactaccgtttccggacccgtacgggaaccgtaaaaggtacggaattaacgtaaacgaaaaccgtaacgtacggtacgactacgaacctacgtacttcgttacgtttacctactacttcccg

SEQ ID NO: 306460 - DNA, 537 bp, Homo sapiens
  misc_feature: GZ8MTXP02FJJPY.25.39.D06.1.454.CMB.2.raw
  modified_base (364)..(364): a, c, t, g, unknown or other
  misc_feature (364)..(364): n is a, c, g, or t
  modified_base (442)..(442): a, c, t, g, unknown or other
  misc_feature (442)..(442): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctccaggggtgaaattatgctgactcagtctccagactttcagtctgtgactccaaaggcgaaagtcaccatcacctgccgggccagtcgaagcattggtactaatttacactggtaccagacaaaaaccaaatcagtctccaaagctcctcatcgagtcctgccttcccagcccatcgtcaggggtccccctcgaggttcagtcggcaggtggatcgtgggacngtacttccaccctcaccatcagtggcctggaaccctgaagatgctgacaacatattactgtacaaactagagttaagngcctccaccctctactaccgtttggcccgaagggggaccaaggccgtaggagaactaccgaaaacgtactaggtcggtacgccacatctgtcttc

SEQ ID NO: 306461 - DNA, 670 bp, Homo sapiens
  misc_feature: GZ8MTXP02IHSE7.25.39.D06.1.454.CMB.2.raw
  modified_base (340)..(340): a, c, t, g, unknown or other
  misc_feature (340)..(340): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtctccgggggaacgagccaccctctcctgccagggccggccagactgttgacaacgacttagcctggtaccacagaagcctggccaggctcccaggctcctcatctatgatacttccaggtaggccacgtcggcactccccagccccgnttccgaggtggccctagtcggggtctggggactggtagtttaccgtcctcaacccatcctaccgaagccctaagacggtaccctaggtaaagtagtttttagtacgttaaggttttaacttacgttagtccgtacgtaccgttcccgacgtaaacggtaagttcgggaccccttaaccctaatttaacttaccttaacccgtttccgggacccccgttaacggggaacccgtaaaaggttacgggaatttaaactaaaccgtaaaaacgtaccgtacggtagggccctaggtcaacccgtaactcgttacgtcctttcgactttcccccg

SEQ ID NO: 306462 - DNA, 573 bp, Homo sapiens
  misc_feature: GZ8MTXP02JE11M.25.39.D06.1.454.CMB.2.raw
  modified_base (152)..(152): a, c, t, g, unknown or other
  misc_feature (152)..(152): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
tcagactgtacagtcacgaccggtgctcgatttagtgacatctcgcagttctttggggggcatgagcaaaaactgacaagtcaaggcaggaagatgttgccatcacaactcattgggtttctgctgctctgggttccagcctccgaggggtnaaattatgctgactcagtctccagtactttcagtctgtgactaccaaaggcaaagtcaccatccaccgtgccggcagtcgancattgtactattacnctgtacagacaaaacaatcagtctacaagctcctcatcgatctgccttccacgccagtcgtcgcgggtccccctggtacggtncggtgctagtggactcggtaggactagtacttccgaccctcgaccacgtacaggtcgcccgtacggaacgtagaagtacttcgacgtcgtaactaactacttaacttaacgtacgtaacgaacgtaggacgtacgtactaccctcctaaccttactacgtaccgtttcgggacgacgggtaacccaggtgaacggtcaaacgacctaaacggtctagcgtcacgactacacttctgttacc

SEQ ID NO: 306463 - DNA, 704 bp, Homo sapiens
  misc_feature: GZ8MTXP02G4BXR.25.39.D06.1.454.CMB.2.raw
  modified_base (343)..(343): a, c, t, g, unknown or other
  misc_feature (343)..(343): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtccgtccggggaacagcccaccctctcctgcagggccgcagactgtgacaacgacttagcctggtaccaacagaacgcctggcccagggcctcccgaggcctaccgtcatctatgactacttccagtacggccagtggcactcccagcccgtnttcgagtggccctaggtcggtctggggactaggtacgtttcctcgtaccacctactcctaccacgtcccttaagacgtacccgttaggaacgtttcttttacggactttaggttttacttaccgttgtaccgtagtacccttccggaaacgaaaaggtaggtccccggtacccttaaacccttaaacgtttactttacccggtaccgtttttaccgggacccccgttagggggaaaaccctaaggggttaccgtaaaacttaactaaacccggaaaacgttaacccgttcgggtacggtaacccttgaaacccccgttacgttaccgtacgttccgttaccctttacctaccgtttccccg

SEQ ID NO: 306464 - DNA, 626 bp, Homo sapiens
  misc_feature: GZ8MTXP02FL0D1.25.39.D06.1.454.CMB.2.raw
  modified_base (326)..(326): a, c, t, g, unknown or other
  misc_feature (326)..(326): n is a, c, g, or t
  modified_base (378)..(378): a, c, t, g, unknown or other
  misc_feature (378)..(378): n is a, c, g, or t
tcagactgtacagtcacgaccggtgctcgatttagtgacatctcgcagttctttggggggaggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggcagactgttgacaacgactagcctggtaccaacagaagcctggccaggcctcccaggcctcctcactctatgatactccaggtagggccactggccanccccagccccgcttcaggtggcccaggtgggcgtggggacaggtagtttacnctcaccatcctccgacgccctaagacgcccgtagtaaacgttagttttgtactagttttaacttacttggtaccagtccctacccgtacgaaacggaaggttcggacccttaccctaaattactttacctaaccgtttcccgggacccgttacggggaaccgaaaacggtacgtaaacgttaacttacgaaaaacgtacgtacgttacggcttacggaacacctagtctcgttcttactacttccccg

SEQ ID NO: 306465 - DNA, 696 bp, Homo sapiens
  misc_feature: GZ8MTXP02JU26W.25.39.D06.1.454.CMB.2.raw
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagcccaccctgtctttgtcgtccgggggaacagcccaccctctcctgcgacgggccggccagacttgttagaaccaacgtacttagcctaggtaccaacagaacgccgtggccaggcctcccgaggcctcctcatctatgactaccttaccgaggtacggccacgtggacctactccccgagccccgtcttcgaggtcgccgtaggtcggggtcgtaggggacaggttacgtttctcctacacctactcctccgacgtaccctaaggacgtaccgttaggtaagttacgttttacgacgtttaagtttacttaacgtcgtacgtaacgtccgtacggtacgaaaggtacgtaccggtaccttaactaaacttacgtttacccgttaccggtttaccggacccccggttaagggaaaacccgttaagggtacggtaaaactaaccgtaaacgaaaaccgtaacggtcggtcggtaacctcggaacctaccgtactcgtttacttccttacgacctttccccgg

SEQ ID NO: 306466 - DNA, 619 bp, Homo sapiens
  misc_feature: GZ8MTXP02JBBLQ.25.39.D06.1.454.CMB.2.raw
  modified_base (426)..(426): a, c, t, g, unknown or other
  misc_feature (426)..(426): n is a, c, g, or t
  modified_base (593)..(593): a, c, t, g, unknown or other
  misc_feature (593)..(593): n is a, c, g, or t
  modified_base (608)..(608): a, c, t, g, unknown or other
  misc_feature (608)..(608): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtcttgtcgtccgggggaacacgccacccctctcctgcgacgggccggccagactgtgacaacgactagcctggtaccaagagaagccgtggccaggcctccgaggcctcctcatctatgactcttcaggtacggccatcggcactcccagcccctctcaggtcgccgaggtgggccgtaggacgagttacgttcctactaccaccgtactcctaccgactccgtagacgacctagtaaagtnttttgacgttagtttacttaactgtactacgtacctacgacgtaacgtaagtccgtacctaacctaagttacttaccgtaccgtttaccggacccgttacgggaaacaaacggtttcggaaaactacgtaacgtaaaacgaccgttagccgaagtccgaactaaccnctaccgtctaccttntaccctttccg

SEQ ID NO: 306467 - DNA, 666 bp, Homo sapiens
  misc_feature: GZ8MTXP02JZ7NW.25.39.D06.1.454.CMB.2.raw
  modified_base (152)..(152): a, c, t, g, unknown or other
  misc_feature (152)..(152): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (389)..(389): a, c, t, g, unknown or other
  misc_feature (389)..(389): n is a, c, g, or t
  modified_base (427)..(427): a, c, t, g, unknown or other
  misc_feature (427)..(427): n is a, c, g, or t
tcagactgtacagtcacgaccggtgctcgatttagtgacatctcgcagttctttggggggcatgagcaaaactgacaagtcaaggcaggaagatgttgccatcacaactcatttgggtttctgctgctctgggttccagcctccgaggggtnaaattatgctgactcagtctccagtactttcagtctgtgactccaaaggcgaaagtcaccatcacctgcccgggcagtcggagctattggtactaattacactggtaccagacaaaaccatcagtcacaagctcctnatcgatctcgctcccagccccatcgtacgacggggtccccngtaggttcaggtccggctaggtgactcgtagggactgtacctttccgacccttcaaccnttaccgaggtcggacccgtagggaaccctagggaaagngttcgactacggaacaacttattacttaacgtcgtaacaaacgtggtagtacggttatcccctacctaacccctagtaaccccgttacgttttacgggaaccccggttaagggggacccctaaaaggtcccggtagggggtaaaacctacgaaaaccgttaaaaccggaccgtttcgggggtaacgggtaccctaccgggacccttaacccggtactttacccggtttaccgtttaccc

SEQ ID NO: 306468 - DNA, 706 bp, Homo sapiens
  misc_feature: GZ8MTXP02G5R4L.25.39.D06.1.454.CMB.2.raw
  modified_base (156)..(156): a, c, t, g, unknown or other
  misc_feature (156)..(156): n is a, c, g, or t
  modified_base (232)..(232): a, c, t, g, unknown or other
  misc_feature (232)..(232): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctgggttccagcctcgaggggtgaaattntgctgactcagtctccagtactttcagtctgtcgactaccaaaggcgaaagtcacatcaccgtgccggcagtgganctagttgtactattcactggaccagacaaaaccatcagtactaccaaancctacctanatcgagttctcgtcccttacccgagtccccagttcggtaaccggtccggggttcccccctaggtacggtttaccggcggtacggtacgtaggtcggtacgtacggtaggtactacgttaccttacccaccctacaacctagtacgtacggtacgtaccgtacggtaaccgtaggaagtacgtcgtactaacgtaactaaacttaacgttaacgttacgtacgtaaacgaaacggtaggtacgttacgtacctaccctaacccgtaccttaacgttaaccgttaccggttaccggaaccgggtaaccggggtaacctacggtacggaaacggtaacgtaaacgtaaccgtaaacggtaaccgtgggtaaccgtaccgtaccggtaaccctacgttaccgtttaccgttacgtttacc

SEQ ID NO: 306469 - DNA, 793 bp, Homo sapiens
  misc_feature: GZ8MTXP02F9362.25.39.D06.1.454.CMB.2.raw
  modified_base (149)..(149): a, c, t, g, unknown or other
  misc_feature (149)..(149): n is a, c, g, or t
  modified_base (234)..(234): a, c, t, g, unknown or other
  misc_feature (234)..(234): n is a, c, g, or t
  modified_base (281)..(281): a, c, t, g, unknown or other
  misc_feature (281)..(281): n is a, c, g, or t
tcagactgtacagtcacgaccggtgctcgatttagtgacatctcgcagttctttggggggcatgagcaaaactgacaagtcaaggcaggaagatgttgccatcacaactcattgggtttctgctgctctggttccagcctccaggggtnaaattatgctgactcagtctccagtactttcagtctgtgacctaccgaaaggcgaaagtcaccatccaccgtgccggcagtcganctatgtactattcactgacagacaaacaatcagtcacaagctcctanatcgatctgcttcccacgcccagtcgtcgtaccggggtccccctggtagttcgagtcggcgtacggtggtactcggtacgggaactcggtaacttccctaacccccgttaccaaccgtacgttcccgaaggggtttaccggacccgtttaaacgggaaacccgttacgggaaaaggtaccgttaggaccccgtttagaaacccgtaaaacgttagtttaaccttaacgtacggtaaacccttaaacgaacgggttaagttaaccggttccggaaacccctttacccccgaaaacccgtttaccctaacccggtttttaaaccccgggttttccggggaacccccggggtaaaacgggggtaacccccgaaacgggttaggttaaccggggtaaaaccggaaacgtttaaaccccggaaaaaacccggttcccggttaaacgggttccggggacccggtttaacggaaacccccgtaaatttacccccggtttacgtttaccggtttaacccg

SEQ ID NO: 306470 - DNA, 689 bp, Homo sapiens
  misc_feature: GZ8MTXP02GWAMA.25.39.D06.1.454.CMB.2.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (390)..(390): a, c, t, g, unknown or other
  misc_feature (390)..(390): n is a, c, g, or t
tcagactgtacagtcacgaccggtgctcgatttagtgacatctcgcagttctttggggggaggaactgctcagttaggacccagagggaaccatggaagccccagctcagcttctcttcctcctgctactctggctccagattccagcggcgaaactgtgttgacacagtctccagccacctgtctttgctccggggaacngccacctctcctgcagggccgcagactgtnaacaacgacttagcctggtaaccaacagaacgccgtggccaggcctcccgagcctcctacatctaatgatacttccagtacgggcccaatcggacactcccagtccccgcttacagtttcggacctaggtcggtactaggggactagtacgttttaccncctacaaccgtactacctacacgtaccgtaagacgtacgtaagtaagttactttacgtacgttaacgttttaactacgtacgtactaacgtaccgtaccgaaacgaaaacggtacgtaccgtaccctaaccttaaacttacgtttactaacccggtttcccggacccggtaaacggggtaaaaccgtaaaaggttacgtaaactttaaacgtaaaaccgtaaaaccggtaacgtacggtacggtacctacgtaacctaacgttaacttcgttacttaccgttaccgttaacttcccccg

SEQ ID NO: 306471 - DNA, 728 bp, Homo sapiens
  misc_feature: GZ8MTXP02IEC52.25.39.D06.1.454.CMB.2.raw
  modified_base (344)..(344): a, c, t, g, unknown or other
  misc_feature (344)..(344): n is a, c, g, or t
tcagactgtacagtcacgaccggtgctcgatttagtgacatctcgcagttctttgggggaggaactgctcagttaggacccagagggaaccatggaagccccagctcagcttctcttcctcctgctactctggctcccagattccagcggcgaaactgtgttgacacagtctccagccaccctgtctttgtctccggggaacagccaccctctcctgcagggccggccagactgttgacaacgtacttagcctggtaaccaacagaacgcctggccaggcctcccgaggcctcctcatctatgactacttccagtacggccacgtggcactccccgagccccgnttcgaggtgccgtaggtcgggtctaggggactaggtagtttacctcctactaaccctattcctacccgagtcccctaagaccgtccttaggtaaagttacgtttttaggtaccttaagttttaaactttaccgtttaggtacctaacgggttcccttacccggacgtaaacgggtaaacgttcggggtaccccttaaccctaaaacgtttacttaccgttaaaccgttttcccgggtaacccccgttacggggtaaaacccgtaaaacggtttacgggtaaaacgtttaacctaaacgtaaaaaccggtaaccttagggttacggaccttacgaaccgtaaccgtaacttccgttacgtttcctttaccgtaacgtttcccccg

SEQ ID NO: 306472 - DNA, 768 bp, Homo sapiens
  misc_feature: GZ8MTXP02IVY61.25.39.D06.1.454.CMB.2.raw
  modified_base (621)..(621): a, c, t, g, unknown or other
  misc_feature (621)..(621): n is a, c, g, or t
tcagactgtacagtcacgaccggtgctcgatttagtgacatctcgcagttctttggggagctgtgggcttaggaagcagagcctggggcatctccaccatggcctggaccccctctcctcctccagcttctcaccctctgctcagggtcctgggcacagtctgcgctgacccaggaagactcggtgtcggggaccgtggacagaagtcaccctgtcttgttctggtacgagcgaacaactagttacggaacgttatcccgtggtcgggaccttacgggtaaccaaacgaggtaaacgttcggtaccaacccgggtaacccccccaaaaagttcggtacgaagttcggttaccgttagggaacgttacgttcggtttacccccgtccccgtacggaacggggtacccttcccccggttccgggtcccccgttaccgttttccgttacccggttggggttaccgtacggttccggttaccggttacggggaccccacgtacccggttcccctccgttcgaacgtacgtcccggaccgggtccctacgacgccgtaggacggtacgacggcccgttcgtaactcgtacgcttcgacggtctaaggtcggtactacgtcgtaccncggttccgcgttcgtccgttcggtacgggtttccgggttccgggggccgggggttacccggttacggtacccggttcggtacggtaaccgcgtaccgaccgtccgtaccgtcccgtacgtcaccttccgtccgtccccgtacttccc

SEQ ID NO: 306473 - DNA, 533 bp, Homo sapiens
  misc_feature: GZ8MTXP01AWPXH.19.49.E05.1.454.CMB.2.raw
  modified_base (270)..(270): a, c, t, g, unknown or other
  misc_feature (270)..(270): n is a, c, g, or t
  modified_base (408)..(408): a, c, t, g, unknown or other
  misc_feature (408)..(408): n is a, c, g, or t
  modified_base (455)..(455): a, c, t, g, unknown or other
  misc_feature (455)..(455): n is a, c, g, or t
  modified_base (495)..(495): a, c, t, g, unknown or other
  misc_feature (495)..(495): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagcttggtcaagcctggagggtccctgagactctcctgtgcagcctcnggattcaccttcagtgactactacatgagctggatccgcaggctccgaggggagggctggagtggttcatatagttagtagtaagtggtaagtaccatatactacgcagactctgtgaagggccattcaaccattccnccgagggaccaacgccaaagactcaactatactctgacaaatgaacngcctgagaacgccggaggaccacgggccgtgttacttcgngcgcgaagaacttcgaaagggtcccgaaagggggtccg

SEQ ID NO: 306474 - DNA, 568 bp, Homo sapiens
  misc_feature: GZ8MTXP01BF2BV.19.49.E05.1.454.CMB.2.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (522)..(522): a, c, t, g, unknown or other
  misc_feature (522)..(522): n is a, c, g, or t
tcagtactctcgtgcacgaccggtgctcgatttagagcgactagcaacacacaaaggggagctctgggagaagagccccacgccccagaattcccaggagtttccattcggtgatcagcactgaacacagaggactcaccatggagtttgggctgagcttgggttttccttgttgctattataaaggtgtccagtgtcaggtgcagcgtgggtgggaggtcgtggggggaggtcttgggtcaagccgtgggacgggtccctgagactctcctgtgcngcctgnggattccaccttcagtgactactacntgagctggactccgcaggccncgagggggaggctggagtggtttacattatagttagagtagtgtaataccattatacacgcagtctcgtgtacggaagggccattccaccnttcnccgaaggacaacgccaaagactcaacttntactctagacaaatcgaacngcctagacggcgacccggaggcccgacgggtccgttagttacgttccngggcggtacaaaggttaactcggaaaacgggccgaaagggggtccc

SEQ ID NO: 306475 - DNA, 590 bp, Homo sapiens
  misc_feature: GZ8MTXP01AQ3JX.19.49.E05.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (477)..(477): a, c, t, g, unknown or other
  misc_feature (477)..(477): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtgggagtcgtgggggagcttggtcaagcctgggagggtccctgagactctcctgtgcagcctntggattcaccttnagtgactactacatgagctggactcccgcaggcctccggagggggagggctgggagttgggtttcatatattaggtagtaagtggtaagtaccatatactacgcagactcgtgtagaacggggccattccaacctatcctaccgagggaccaacggaccaaagactcaactatactctagacaaatgaaaccnggccctaggacggaacggcccggaagggacccacggggtcccgttggttaacttacgcggaaccgggacgaaaggttaaacgtcggaaacgggtcccgttaaaggggggtccc

SEQ ID NO: 306476 - DNA, 567 bp, Homo sapiens
  misc_feature: GZ8MTXP01AS76I.19.49.E05.1.454.CMB.2.raw
  modified_base (274)..(274): a, c, t, g, unknown or other
  misc_feature (274)..(274): n is a, c, g, or t
  modified_base (397)..(397): a, c, t, g, unknown or other
  misc_feature (397)..(397): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtgggggagcttggtcaagccgtgggacgggtccctgagactctcctgtgcagcctcnggattcaccttcagtgactactacatgagtcgtggactcccgccaggcctaccggagggggagggctggagttggttcatatattagtagtaagtgggtaataccatactactagcagacctntgtagaagggccattcacntcncgagggacaacgcaagactacactatactctgacaaagtcgaaactacggccctaggaacggaacggccggaaagggaccgacgggtccgttagttacgttcgcggaacgacgaagtaaatccggaagggtcccgaaagggggtcccg

SEQ ID NO: 306477 - DNA, 639 bp, Homo sapiens
  misc_feature: GZ8MTXP01CM5IT.19.49.E05.1.454.CMB.2.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (539)..(539): a, c, t, g, unknown or other
  misc_feature (539)..(539): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagcttgggttttccttgttgcttattataaaaggtgtccagtgtcaggtgcaggctggtggagtcgtgggggagcttggtcaagccgtgggacgggtccctgagactctctgtgcagctnggacttcacctnagtcactacanagtgagtcgtggactcccgacgaggcccgtacggaagggggacgggcgtaggggaggtttggggtttacccaagtttagttagtttaaggtagttaaagggttacgggttaacgtaaccctaattaacgttaacctacggactaacgtacttcgtaggtaggaacgggtccgtacttccaaccgtactccgtaccgaacgggaacaaaccgaccaaagtaacctacaaccttataactctanacgtaaataggaacacgaccgtagacggaacgaccggagaccgcgtaccgtgttacgttcgttgccgagaacgaattcgaacggtccggaagggtaaccg

SEQ ID NO: 306478 - DNA, 658 bp, Homo sapiens
  misc_feature: GZ8MTXP01EBPGU.19.49.E05.1.454.CMB.2.raw
  modified_base (466)..(466): a, c, t, g, unknown or other
  misc_feature (466)..(466): n is a, c, g, or t
tcagtactctcgtgcacgaccggtgctcgatttagagcgactagcaacacacaaagggggagctctgggagaagagccccagccccagaattcccaggagtttccattcggtgatcagcactgaacacagaggactcaccatggagtttgggctgagcgtgggttttccttgtgctattaataaaggtgtccagtgtcaggtgcagcgtgggtggagtcggtgggggagcttgggcaagccgtggagggtccctgacgactctctgtgcagtcctctgacttccaccttgagtcgaactactacatgagtcgtaggactcccggaccgaggtcccgtcggaaggggggaaggggtcgttaggggaggttcgggtttaccaagttagttagttaaggtagtaacgggtggtaacgtacctatactacacggctagtactgtaggagaacggggctacttcaaccctntaccgacgaacggaaccaacgaccaaacgtaccttacaaacttactactacgtacgaaactaaagtacgaacgtcgtacgtaggaagccgggacggaacggtacccgaccgggtcgttaggttaccgcggttcggaaccgaaggtaaacgttaaacgtaccgggaaaccgggtccggggaacggggtaaccg

SEQ ID NO: 306479 - DNA, 647 bp, Homo sapiens
  misc_feature: GZ8MTXP01A5SB1.19.49.E05.1.454.CMB.2.raw
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (445)..(445): a, c, t, g, unknown or other
  misc_feature (445)..(445): n is a, c, g, or t
  modified_base (508)..(508): a, c, t, g, unknown or other
  misc_feature (508)..(508): n is a, c, g, or t
tcagtactctcgtgcacgaccggtgctcgatttagagcgactagcaacacacaaagggggagctctgggagaagagccccagccccagaattcccaggagtttccattcggtgatcagcactgaacacagaggactcaccatggagtttgggctgagcttgggttttccttgttgctattaataaaggtgtccagtgtcaggtgcagctgggtggagtcgtgggggagcgttggtcaaggccgtgggagggtccctgagctctcctgtcgcagcctcgnggacttcaccttnagtcgactactacatgagcgtggactcccgcgaggcctaccggagggggagggtcgtgggaggttgggttaccattagtagttagtaggtaagtaggtaatacctatactactacgcagtactgtaggtacggaagggcctaattccaacctntccaccgagggaccaacgaccaaacgactcaacttatactcctagaacctaaagtacgaaacnccggtacctaggaacggaaccggacccgggaaacgggtacccgaaaccggggttccgtttaaggttactttccgggaggaacccggtaaggaagttaaaacgttcgggaaacgggtaacccgggaagggggttaacccg

SEQ ID NO: 306480 - DNA, 627 bp, Homo sapiens
  misc_feature: GZ8MTXP01DAXMX.19.49.E05.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgcagctggtggagtcgtgggggagcttggtcaagccgtggagggtccctgagactctcctgtgcagcctcnggacttcaccttnagtcgactactacatgancgtggactccgcaggctacgaggggagggcgtggngtggttcattatagtagtagtaagtgtaagactatatacacgcagctcgtgtagacgggcctattcccaacgtactaccgtaccgaagggacccaaacgacccaaaggtaaaccttaccaaacttaaatacttacgtaacgaacctaaaagtacggaaacacggtcccagggaacggaaccgggaacccggaaggggaacccgacgggtacccggtgttaacgttccgacgggaacggtaaccggaagttaaaacgtcggaaacggggtccggaaacggggggtaacccg

SEQ ID NO: 306481 - DNA, 515 bp, Homo sapiens
  misc_feature: GZ8MTXP02I57ZL.19.49.E05.1.454.CMB.2.raw
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagcttggtcaagcctggagggtccctgagactctcctgtgcagcctctggattccaccttcagtgactactacatgagctggatccgcaggctcgagggaggctggagtggttccatatattagtagtagtgtagtaccatatactacgcagactntgtgaagggccattccacatctcagggacaacgccaaagactcaatatatctgacaaatgaaacngactgacgacgacgaggacgacggcgtagtactcgngaacgacgaaagtaacgtacgaacggacgaacgggc

SEQ ID NO: 306482 - DNA, 515 bp, Homo sapiens
  misc_feature: GZ8MTXP02JJ4O7.19.49.E05.1.454.CMB.2.raw
  modified_base (485)..(485): a, c, t, g, unknown or other
  misc_feature (485)..(485): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtctgggggaggcttggtcaagcctggagggtccctgagactctcctgtgcagcctctggattcaccttcagtgactactacatgagctggatccgcaggctccgagggagggctggagtggttcatatatagtagtagtgtgtacagtatactacgcagactcgtgtgaagggccattcaccatctccgagggacaacgccaagaactcactatacgtctagacaaatgaacagccagagacgccgaggaccacgggcctagtacttacgngcgacgaacgaactacgaacggacgagggc

SEQ ID NO: 306483 - DNA, 523 bp, Homo sapiens
  misc_feature: GZ8MTXP02G1FQU.19.49.E05.1.454.CMB.2.raw
  modified_base (295)..(295): a, c, t, g, unknown or other
  misc_feature (295)..(295): n is a, c, g, or t
  modified_base (456)..(456): a, c, t, g, unknown or other
  misc_feature (456)..(456): n is a, c, g, or t
  modified_base (492)..(492): a, c, t, g, unknown or other
  misc_feature (492)..(492): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagcttggtcaagcctgggagggtccctgagactctcctgtgcagcctctggattcaccttcagtgactactanatgagctggactccgcaggcctccgagggaggctggagttggttcatatattagtagtagtggtgtacatatactacgcagactcgtgtagaaggctattcactctctaccgagggacaacggaccaaagtactacaactatagtctagacaaatgaaacngctagagacgacgagtacgacggcgtgtacttacgngaacgagaagtaactcgaacggacggaggcg

SEQ ID NO: 306484 - DNA, 532 bp, Homo sapiens
  misc_feature: GZ8MTXP02JG3P9.19.49.E05.1.454.CMB.2.raw
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctgggtggagtcgtgggggagcttggtcaagcctgggagggtccctgagactctcctgtgcagcctctggattcaccttcagtgactactacatgagctggactccgcaggctcgagggagggctggagtggttcatatatagtagtagtgtagtaccatatactacgcagactntgtagaacgggctattccacatcncgagggacacgcaagactcactanatcagacaaatgaacngaccgtgagacgccggagaccgacgggccgttagtaacttcgnggccgtacggaaaggtaaacttgaaacgggaccgaaagggggtccc

SEQ ID NO: 306485 - DNA, 511 bp, Homo sapiens
  misc_feature: GZ8MTXP02FJXNI.19.49.E05.1.454.CMB.2.raw
  modified_base (404)..(404): a, c, t, g, unknown or other
  misc_feature (404)..(404): n is a, c, g, or t
  modified_base (482)..(482): a, c, t, g, unknown or other
  misc_feature (482)..(482): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggaggcttggtcaagccgtgggagggtccctgagactctcctgtgcagcctctggattcaccttcagtgactactacatgagctggatccgccaggctccgaggggaggctggagtggttcatatatagtagtagtggtagtaccatatactacgcagactctgtgaagggccgattcacatcncagggacaacgccaaagaactcatatatctagacaaatgaaacagcctagagacgccgaggacacggcgtgtactacngccgagacgaaatcgaacggccaaggggc

SEQ ID NO: 306486 - DNA, 502 bp, Homo sapiens
  misc_feature: GZ8MTXP02ISXF0.19.49.E05.1.454.CMB.2.raw
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtctgggggaggcttggtcaagcctggagggtccctgagactctcctgtgcagcctctggattcaccttcagtgactactacatgagctggatccgcaggctcgagggaggggctggagtggttcatatattagtgtagtggtagtaccatatactacgacagactctgtgaaggccattcacntcncaggacacgcaagactcactanatctgacaatgaaacngacngacgacgcgagacgacggctagtactcgngcgagaacgaaactcgaacggaccgaagggtc

SEQ ID NO: 306487 - DNA, 531 bp, Homo sapiens
  misc_feature: GZ8MTXP02IOJDN.19.49.E05.1.454.CMB.2.raw
  modified_base (450)..(450): a, c, t, g, unknown or other
  misc_feature (450)..(450): n is a, c, g, or t
  modified_base (490)..(490): a, c, t, g, unknown or other
  misc_feature (490)..(490): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagcttggtcaagcctggagggtccctgagactctcctgtgcagcctctggattcaccttcagtgactactacatgagctggatccgccaggcctccgaggggagggctggagtggttcatatattagtagtagtggtagtacatatactacgcagtactctgtgaagggcgattcacatctccgagggacaacgccaaagaactcactatatctagacaaatgaaacngacctgacgacgccgaggaccgacggcgtgtaacttacgnggcgacgaagtaaaacttcgaaacgggccgaaagggggtcc

SEQ ID NO: 306488 - DNA, 568 bp, Homo sapiens
  misc_feature: GZ8MTXP02JHI06.19.49.E05.1.454.CMB.2.raw
  modified_base (376)..(376): a, c, t, g, unknown or other
  misc_feature (376)..(376): n is a, c, g, or t
  modified_base (525)..(525): a, c, t, g, unknown or other
  misc_feature (525)..(525): n is a, c, g, or t
tcagtactctcgtgcacgaccggtgctcgatttagagcgactagcaacacacaaagggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctgggtggagtcgtgggggagcgtgggtcaagcctggtagggtccctgagctctcctgtgcagcctctggcttcaccttcagtgactactacatgagctggactccgcaggctcggaggggaggctggagtggttacatatatagtagtagtgtagtacatactactacgnagtactcgtgtaggaacgggtcctaattccaacctagtcctaccgaagggaaccaacgaccaaagtaacctcaattactatctagactaaaatcgaaacacgcctagaacgacggaccggaaggaccgacggtccgttagtacttacgnggaaccgacgaaagtaaactcggaaacggtccgaaaggggtcc

SEQ ID NO: 306489 - DNA, 596 bp, Homo sapiens
  misc_feature: GZ8MTXP02I4LWM.19.49.E05.1.454.CMB.2.raw
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (390)..(390): a, c, t, g, unknown or other
  misc_feature (390)..(390): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtgggggaggcttggtcaagcctgggagggtccctgagactctcctgtgcagcctctggattcaccttcagtnactactanatgagctggactccgccaggcctccgaggggaggggctggagttgggttcatatattagtagtagtggtagtaccatatacctagcagactcngtgaagggcgattcacatctaccgagggaccaacgaccaaagaactcaactatatctagacaaagtcgaaacacgccgtgaacgaacggcccggaagggaacccgacgggtaccccggttaggtaaactttacccgtaggaaccggaccggtaaaggtaaaacgtttaccggaaaacggggtacccggaaaggggggttaaccccg

SEQ ID NO: 306490 - DNA, 616 bp, Homo sapiens
  misc_feature: GZ8MTXP02I5CGC.19.49.E05.1.454.CMB.2.raw
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtgggggaggcttggtcaagcctgggagggtccctgagactctcctgtgcagccctcgtggcttctaccttcagtcgactactacatgagctggactccgcgaggcctcgaggggaggcgtggaggttggtcatatatagtagtagtgtagtactatactactacgacagacttcgtaggtaggaacggggtcctattcccactactccgtaccggaagggaaccaaaccgtaccgaaaagtacctactaacttaactactacgacgaacaaaagtcggaaaacgcgtacccgtaggaacgacgggacccggaaggaccgtaccgggccgttagtaaaacgtttcgacgggaacgaacgtaaagtaaaaccgttcgaaccgggaccggaaggggtacccg

SEQ ID NO: 306491 - DNA, 541 bp, Homo sapiens
  misc_feature: GZ8MTXP02H5GT5.19.49.E05.1.454.CMB.2.raw
  modified_base (335)..(335): a, c, t, g, unknown or other
  misc_feature (335)..(335): n is a, c, g, or t
  modified_base (468)..(468): a, c, t, g, unknown or other
  misc_feature (468)..(468): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtgggagtcgtggggggagcgttggtcaaggcctgggagggtccctgagactctcctgtgcagcctctggattcaccttcagtgactactacatgagctggatccgcaggctcgagggagggctggngtggttcatatatagtagtagtgtgtaccatactactacgcagactctgtagagggcctattccaacctatctaccgaaggggacaaacgaccaaagaaacctcaactatactctagacaaaatgaacaagcngagagacgaggacgacggaccgtacgtacgttacgtacgcgcgaacgaaattacgaacggacgaacggaacgg

SEQ ID NO: 306492 - DNA, 560 bp, Homo sapiens
  misc_feature: GZ8MTXP02GJHGJ.19.49.E05.1.454.CMB.2.raw
  modified_base (288)..(288): a, c, t, g, unknown or other
  misc_feature (288)..(288): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtgggggaggcttggtcaagcctggagggtccctgagactctcctgtgcagcctctggattcaccttcagtnactactacatgagctggatccgccaggctccgaggggagggctggagtgggttcatatattagtagtagtggtagtacatatactacgcagactctgtgaagggccattcacatctccagggacaacgccaaagaactacactatatctagacaaatgaaacagacctagaagacgacccggaaggaccgaacggggaccgttagtaacttaaccgtaggccggaacggaaaggaaaacttacgaaaacgggacccgaaaaggggggtaccg

SEQ ID NO: 306493 - DNA, 567 bp, Homo sapiens
  misc_feature: GZ8MTXP02GMBVV.19.49.E05.1.454.CMB.2.raw
  modified_base (287)..(287): a, c, t, g, unknown or other
  misc_feature (287)..(287): n is a, c, g, or t
  modified_base (430)..(430): a, c, t, g, unknown or other
  misc_feature (430)..(430): n is a, c, g, or t
  modified_base (487)..(487): a, c, t, g, unknown or other
  misc_feature (487)..(487): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagcttggtcaagcctgggagggtccctggagactctccgtgtgcagccctctggacttcaccttnagtgactactacatgagctggactccgacaggcctccggaggggaggggctagggagttgggtttacagtattagttagtagtagttggtagtaccattatactacgcagacctgtggtaggaacggggctattccgaacctntcctaccgagggaaccaacgaccaagaactcaactatatctagacaaagtgaaaccngcgagagacgccggagaccgacggtcgtatacgtacgacgaacgacgaaagtaacgtacggaacggaccggaacgggtcc

SEQ ID NO: 306494 - DNA, 531 bp, Homo sapiens
  misc_feature: GZ8MTXP02IC08F.19.49.E05.1.454.CMB.2.raw
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggagtcgtgggggaggcttggtcaagcctggagggtccctgagactctcctgtgcagcctctggattcaccttcagtgactactacatgagctggatccgcaggctcgagggagggctggagtggttcatatatagtagtagtggtgtacatatactacgnagactntgngaggcgatcacatcncgagggacacgccaaagactacactatatactagacaaatacgaaacacgacctagaggaacgacccgaaggaccgacggccgtaggtacttacgtgcgacgaagtaaacttacgaacggtacgaaacggggtccg

SEQ ID NO: 306495 - DNA, 548 bp, Homo sapiens
  misc_feature: GZ8MTXP02ILAE4.19.49.E05.1.454.CMB.2.raw
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgcagctggtggagtcgtgggggagcgttggtcaagccgtgggagggtccctggacgactctcctgtgcagcctcgtggacttccaccttcagtgactactacatgagctggactccgcgaggcctcggaggggacggggctgggagtggtactttcattatattagtagtagtggtatacatatactagcanactngtagaacgggcattcacctatccacgaggacaacgccaaagactcaactatactctagacaaagtacgaactagcctagacgacgcggacggacacggtcgtagtacttacgnggacgacgaagtaaactcgaaacggaccgaacgggg

SEQ ID NO: 306496 - DNA, 577 bp, Homo sapiens
  misc_feature: GZ8MTXP02FQ57M.19.49.E05.1.454.CMB.2.raw
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (482)..(482): a, c, t, g, unknown or other
  misc_feature (482)..(482): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggagcttggtcaagcctgggagggtccctgagactctcctgtgcagcctntggatcaccttnagtgactactacatgagctggactccgcaggcctccggaggggagggctggtacggttgggttccatatagttagtagtagtggtacgtaccatactactacgacagtcctgtggtagaacggggtcctattccgactatccgtaccgaggggaaccaacggaccaaaagacctacaatatatctagacaaagtgaaacngcctaggacgacggacccggaggaccgacgggtccttagtaccttacgacgaacgtacggaaataacgtcgaaaacggggcgaacgggggtaccg

SEQ ID NO: 306497 - DNA, 672 bp, Homo sapiens
  misc_feature: GZ8MTXP02GBS9C.19.49.E05.1.454.CMB.2.raw
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgcagctgggtgggagtcgtgggggaggtcgttgggtcaagccgtgggacgggtccctagacgactccgtcctggtgcacgcctcgtggtacttccaccttcagtcgactactacatgagtctggactcccggcgaggcctccgggaaggggtacggggcgtaggggtagttggggtttaccaagttagttagttaggtaggttaggttaggtacgtaccagttactacgtacgatacgtactcgtggacggtaacgggaccgtattcccgaacgtactaccgtacccggaacggggaaaccaacccggtaacccgaaaagtaacccctactaaacttacgttaactttacgaacgtaacctaaaagtacgaaacagccgtagaacggacgaccggtaggaccgacggaccttggtacttacggcgaacgtcgaaaacgtaacgtacggaacggaccggaacggggtaccg

SEQ ID NO: 306498 - DNA, 668 bp, Homo sapiens
  misc_feature: GZ8MTXP02FMIT9.19.49.E05.1.454.CMB.2.raw
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagcttgggttttccttgttgctattagtaaaggtgtccagtgtcaggtgcagctgggtggagtcgtgggggagtcgttggtcaagccgtgggacgggtccctgacgactctccgtgtcgcagccctgtggacttccaccttgagtcgaactacctacgagtggacgtcgtggtacctccccgacgaggtcctaccgggaagggggaacgggtcgtaggggtacggttggttaccagttagtagtttagtaggtaggttaggtactacctatactaccgtagacagtcttcgtaggtacggaacggtccttattacccgactacttccgaaccggaggtaaccaaccggaaccaaacgtacttaccacttatacgtacgtacgaacgaaagtacggaaactcgaccgtagggaacgacgtaccggagaaacgtcggttacggtaccgttagtaacgttacgcggaccgtaagggtaaaacttaacggtacgaaccggggtaacggtaaccggggg

SEQ ID NO: 306499 - DNA, 625 bp, Homo sapiens
  misc_feature: GZ8MTXP02IDCWV.19.49.E05.1.454.CMB.2.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
tcagtactctcgtgcacgaccggtgctcgatttagagcgactagcaacacacaaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggagtcgtgggggaggcttggtcaagcctgggaggtcccngagacttctcctgtgcagcctcgtgtctcctctgtgctactacanagngntcgagtaccgccgacggcgcgtacgggaggggaggtcgtaggtaggttcggtactagtagttagtaggtagtaggtagttacgtacgtatacgtaacgtacgacgaactcgtcgtagggaggaccggtactactaccacttctacccgacggaaacggaacaccgaacgtaaactacccacttataactcttacctaggaaaattacaacgaacgtccgacggtaagacgggaaccggacggacgtaaacggtaacgggtccgttaataccgttacgcggaaccgagaaaacggtactaacgggacccgggaaggaccggttacgg

SEQ ID NO: 306500 - DNA, 421 bp, Homo sapiens
  misc_feature: GZ8MTXP01CDHT5.3.59.F04.1.454.CMB.2.raw
  modified_base (412)..(421): a, c, t, g, unknown or other
  misc_feature (412)..(421): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccaggggaacccgggtcaccgtctcctcagcctccaccaagggcccatcggtcttccccctggccgcccctgctccaggagcacctccgagagcacagcggcctgggctgcctggtccaaggactactccgagtcgcgtctctgagcgggctggcaaggcgcatagnnnnnnnnnn

SEQ ID NO: 306501 - DNA, 410 bp, Homo sapiens
  misc_feature: GZ8MTXP01A5QX7.3.59.F04.1.454.CMB.2.raw
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (403)..(410): a, c, t, g, unknown or other
  misc_feature (403)..(410): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccggtcaccgtctcctcagcctccacaggcccatcggtcttccccnggcgccctgctccaggngcacctccgagagcacagcggccctgggctgcctggtccaaggctactccgagtgcgtctctgagcgggctggcaaggcgcatagnnnnnnnn

SEQ ID NO: 306502 - DNA, 442 bp, Homo sapiens
  misc_feature: GZ8MTXP01DKBBX.3.59.F04.1.454.CMB.2.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (433)..(442): a, c, t, g, unknown or other
  misc_feature (433)..(442): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttancactgtgggagacaatgtaggtgggggtnactgccccgaatacgtggggccaggggaacccggtcaccgtctcctcacgccctccaccgaagggcccatccggtccttccccctggccgccctgctccaggcgccacctccgagagccacgaggccggcccgtggcctgcctggtacccaaggctacgtccgagtcgcgtctctggacggcgggctgggacaacgggcgcatagnnnnnnnnnn

SEQ ID NO: 306503 - DNA, 479 bp, Homo sapiens
  misc_feature: GZ8MTXP01CIMXB.3.59.F04.1.454.CMB.2.raw
  modified_base (226)..(226): a, c, t, g, unknown or other
  misc_feature (226)..(226): n is a, c, g, or t
  modified_base (467)..(479): a, c, t, g, unknown or other
  misc_feature (467)..(479): n is a, c, g, or t
tcagagacgcactccacgaccggtgctcgatttagtacacacacttagggattggggtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtggagacaatgtaggtgggggtnactgccccgaatacgtggggccagggaacccgggtcaccgtctcctcacgccctccaccgaacgggcccagtccggtccttccccccgtggcccgcccctgcctccgaggacgccacctccgagacgcacacggcccggcccgtggggcctcgccgtggtaccaaacggtccttacgtcccggagtcggccgttctcgtggacggccggggtcgtggggaccgaaagggccgacaagtagnnnnnnnnnnnnn

SEQ ID NO: 306504 - DNA, 424 bp, Homo sapiens
  misc_feature: GZ8MTXP01A7691.3.59.F04.1.454.CMB.2.raw
  modified_base (226)..(226): a, c, t, g, unknown or other
  misc_feature (226)..(226): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (409)..(409): a, c, t, g, unknown or other
  misc_feature (409)..(409): n is a, c, g, or t
  modified_base (416)..(424): a, c, t, g, unknown or other
  misc_feature (416)..(424): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtnactgccccgaatactggggccaggggaacccgggtcaccgtctcctcagcctccaccaagggcccatcggtcttccccctggccnccctgctccaggngcacctccgagagcacagcggccctgggctgcctggtccaaggactacgttccgagtgcgtctctgagcgggctgggcaagggcncgatagnnnnnnnnn

SEQ ID NO: 306505 - DNA, 430 bp, Homo sapiens
  misc_feature: GZ8MTXP01AQNMX.3.59.F04.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(430): a, c, t, g, unknown or other
  misc_feature (418)..(430): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtnactgccccgaatactggggccagggaaccccgggtcaccgtctcctcagcctccacaggcccatcggtcttccccnggcnccctgctccaggngccacctccgagagcacacgcggccctggggctgccctagggtccaaggctacgttccgagtcgcgtctctgaggccgggntggcaagggcganagngnnnnnnnnnnnnn

SEQ ID NO: 306506 - DNA, 447 bp, Homo sapiens
  misc_feature: GZ8MTXP01CV5WP.3.59.F04.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (429)..(447): a, c, t, g, unknown or other
  misc_feature (429)..(447): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtnactgccccgaatacgtggggccaggggaacccgggtcaccgtctcctcagcctccacaggcccatcggtctccccngcnccctgctccaggncacctccgagagcacngccggcctgggcctagcctggtcccaagggtctacttcccgagtcgccgtctctggacggccggggctcggggacaaagggcccgataagtaggnnnnnnnnnnnnnnnnnnn

SEQ ID NO: 306507 - DNA, 481 bp, Homo sapiens
  misc_feature: GZ8MTXP01B9WAO.3.59.F04.1.454.CMB.2.raw
  modified_base (466)..(481): a, c, t, g, unknown or other
  misc_feature (466)..(481): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtaggtgggggtgactgccccgaatacgtggggccaggggaacccgggtcaccgtctcctcagccctccaccgaagggccccagtccggtccttccccccgtggccgcccctcgcctccaggcgccaccctccgagacgccacacgccggccccgtgggcctggccgtgggtaccaaacggtactaccgttcccggagtcgccgttctcgtgggacgggcggggcgtcgggacgaacgggccgactagtagnnnnnnnnnnnnnnnn

SEQ ID NO: 306508 - DNA, 481 bp, Homo sapiens
  misc_feature: GZ8MTXP01CRSO9.3.59.F04.1.454.CMB.2.raw
  modified_base (323)..(323): a, c, t, g, unknown or other
  misc_feature (323)..(323): n is a, c, g, or t
  modified_base (468)..(468): a, c, t, g, unknown or other
  misc_feature (468)..(468): n is a, c, g, or t
  modified_base (474)..(481): a, c, t, g, unknown or other
  misc_feature (474)..(481): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactggtgggagacaatgtaggtgggggtgactcgaccccgaatacgtggggccgaacggggacccggtcaccgtctccctcacgccctccaccgaacggccccagtccggtcccttccccccgnggccgcccctcgcctcccgaggacgccacccgtccgagacgcacgacggccggcccgtgggcctcgccgtggtacccaacggtacctaccgttccgagtcgccgttcgtcgtgggacgggcggggcgtcgggacgaagggcccanagtagnnnnnnnn

SEQ ID NO: 306509 - DNA, 436 bp, Homo sapiens
  misc_feature: GZ8MTXP01ATM97.3.59.F04.1.454.CMB.2.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (420)..(436): a, c, t, g, unknown or other
  misc_feature (420)..(436): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtcgaccgccgcagacacggcctatttancactgtggganacaatggtaggtgggggtnactcgaccccgaatcggtcggggaccgaacggggtaacccggtcaccgtctccctcncgccaccacgacgccncgtccgtcctcccgcgcctcctcgccncgagcnccacgcgacgacgcacgcgccgcgtggctcgcgtagaccgacgtctcgcgngtcgtctcgtgnggcggcggngcgacgacgcannnnnnnnnnnnnnnnn

SEQ ID NO: 306510 - DNA, 418 bp, Homo sapiens
  misc_feature: GZ8MTXP02HR7GD.3.59.F04.1.454.CMB.2.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (411)..(418): a, c, t, g, unknown or other
  misc_feature (411)..(418): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttancactgtgggagacaatgtagtgggggtgactgccccgaatactggggccagggaacccgggtnaccgtctcctcagcctccaccaagggcccatcggtctccccctggccgccctgctccaggagcacctccgagagcacagccggccctgggctgcctggtccaaggactacttccgagtcgcgtctctgagcgggctggcaggcgcatagnnnnnnnn

SEQ ID NO: 306511 - DNA, 426 bp, Homo sapiens
  misc_feature: GZ8MTXP02GT98L.3.59.F04.1.454.CMB.2.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
  modified_base (407)..(426): a, c, t, g, unknown or other
  misc_feature (407)..(426): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtnactgccccgaatactggggccaggggaacccggtcaccgtctcctcagcctccaccaaggcccatcggcttcccccgngccnccngcncagcncaccncgagncacngcgccnggctgctggaccaagcctactcgagtcgcgtctcgnggacggcgggcgtggacaagggccgacatagnnnnnnnnnnnnnnnnnnnn

SEQ ID NO: 306512 - DNA, 447 bp, Homo sapiens
  misc_feature: GZ8MTXP02I60EV.3.59.F04.1.454.CMB.2.raw
  modified_base (226)..(226): a, c, t, g, unknown or other
  misc_feature (226)..(226): n is a, c, g, or t
  modified_base (312)..(312): a, c, t, g, unknown or other
  misc_feature (312)..(312): n is a, c, g, or t
  modified_base (350)..(350): a, c, t, g, unknown or other
  misc_feature (350)..(350): n is a, c, g, or t
  modified_base (398)..(398): a, c, t, g, unknown or other
  misc_feature (398)..(398): n is a, c, g, or t
  modified_base (432)..(447): a, c, t, g, unknown or other
  misc_feature (432)..(447): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtnactgccccgaatacgtgggccacggggacccggtcaccgtctcctcacgccctccacgacggcccatcggtcctcccccgtggccncccctgcctccgaggacgccaccgtccgagacgcacgngccggcccgtggctgcctggccaaggtctacgttccgagtcgcgttcnctggacgccgggcgtggcaacgggcgctagtagnnnnnnnnnnnnnnnn

SEQ ID NO: 306513 - DNA, 497 bp, Homo sapiens
  misc_feature: GZ8MTXP02JO9HD.3.59.F04.1.454.CMB.2.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (474)..(497): a, c, t, g, unknown or other
  misc_feature (474)..(497): n is a, c, g, or t
tcagagacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgacccgccgcagacacggcctatttancactggtggagacaatgtaggtgggggtnactcgacccgaatacgtggggccgacggggaacccggtcacccggtctcctcacgccctccaccgaacggcccagtccggtccctttcccccggcccgccctgcctcgaggcnccacccgtccgagacnccacacggcccggcccgtaggggccctgccgtacggacccgaacggacctaccgtccggaggtcgtccgtctacgtcgggacggggtccggcgtgggacaacgggccgagtagagnnnnnnnnnnnnnnnnnnnnnnnn

SEQ ID NO: 306514 - DNA, 558 bp, Homo sapiens
  misc_feature: GZ8MTXP01AKO3R.52.8.A08.1.454.CMB.2.raw
  modified_base (175)..(175): a, c, t, g, unknown or other
  misc_feature (175)..(175): n is a, c, g, or t
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgcttcttttaagnggtgtccagtgtcaggtgcagctgggtggagtcgtggggggagcgtggtccaggcctggggacgtccctgagactctcttgtgcagcctntggattcaccttcagggtctatgacatgcacgtgggtccncaggcctcgagggcaagggggctgggagtgggtgcctagttanatcataatgaatggaacganaagtatatactatagtacgacgtcggtaggacggtctatcatcactcacagacaacgaacgtaccgaacgaacacgtctagtactacgtacgtactaaagtaacgaacgaacggacgttagacggacgtacgtaacgaacgacgacgtaacgtagtaagttacgttacgttacgtaacgttaacgtaacg

SEQ ID NO: 306515 - DNA, 708 bp, Homo sapiens
  misc_feature: GZ8MTXP01D4CON.52.8.A08.1.454.CMB.2.raw
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggagtccctgagctctcttgngcagcctntggattcacttcgaggtctatgacatgcacgtggggtccccacgagggcctccgagggcgaagggggtctgggaggtggggtcgcctaggttatagtctaagttaacgtagtaagtaggggaaataccaaaaggtattaagtaaacgttattaggtaacgtaacccttaccgggtagggtaaacggggcccgttaaagtttccaagttaccaacttccgtaacccgaaagtaccggaaaccctaaacccgttacccggaaacggaaaacccacgggtacccttaggttaaacttaacccggttaggaaaccctaaaaacgttggaaaacggaacccggggtacgttaggggaaacgttacggtaacgtaacgggaaacgaccggttaacggttaagttaagttaacgtttacgttacgttacgggttaacgttaaaccgttaaacg

SEQ ID NO: 306516 - DNA, 803 bp, Homo sapiens
  misc_feature: GZ8MTXP01B7AXE.52.8.A08.1.454.CMB.2.raw
  modified_base (158)..(158): a, c, t, g, unknown or other
  misc_feature (158)..(158): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttccncgttgctcttttaagaggtgtccagtgtcaggtgcagctggtggagtcgtggggggagcgtggtccaggcctgggagtccctgagctctcttgngcagcctntggatcaccttgagggtctatgactagtgcaccgtgggggtcccncccgagggcctacccgaagggccgaaacggggggtctgggggacggtgggggtcggtacccctaaggtttatagttacctaagttaaagttacgggaagttagggggaaaagtaccgtaaaagggtaacttaaagttaaaccgttaattagggttaaacgtaacccggttccccgggttaaggggaaaccgggggtccccggttaaagttttccccgaaagtttaccccgaacgttaccccttaaaccccggtaagaaacccggggtaaaccctaaaaccccgtttaccccggggaaaaccggtaaaacccaccgggtaacccttaagggttaacccttaacgtttagggaaacccttaaaaaggtacgggtaaacccgaaagggtccgttaacgggaaacgttaaggacccgttaagggaaaaccggttacgaaccggggtccttaagggttaattaacgtttaaccgttggttaaacggaaccgtttaaaaaccgg

SEQ ID NO: 306517 - DNA, 633 bp, Homo sapiens
  misc_feature: GZ8MTXP01DD36V.52.8.A08.1.454.CMB.2.raw
  modified_base (503)..(503): a, c, t, g, unknown or other
  misc_feature (503)..(503): n is a, c, g, or t
  modified_base (549)..(549): a, c, t, g, unknown or other
  misc_feature (549)..(549): n is a, c, g, or t
  modified_base (571)..(571): a, c, t, g, unknown or other
  misc_feature (571)..(571): n is a, c, g, or t
tcagcgcagtacgacacgaccggtgctcgatttagcatactctacagggggggagaggagcccagcactagaagtcggcggtgcttccattcggtgatcagcactgaacacagaggactcaccatggagtttgggctgagtcttgggttttcctcgttgcttcttttaagaggtgtccagtgtcaggtgcagctgggtggagtcgtgggggagcgtggtccaggccgtggggacgtccctgagtctcttcttgtcgcacgcctcgtggtacttcgacctttgagggttctagtgactatcgacctacggttcggggtccccgccgtaggcctacccggaggggaccgaaggggggtcctagggggtagggtcgggggttagacctaaggtttatagtaccgattaagtggaagtaggaaacgactaagtattagtaactagtacgtagtaaccgtcgagggtaaggacctattcatacatactcaggacaacaacctacgaanacgacgcttagtactcacgtacaatacgaagtgactggaagtaacncgttaggaaacgccgtacggtnttagttattaacgtttcgacgtaagtacccggtaattaaacggtccggaagggtaacccggg

SEQ ID NO: 306518 - DNA, 517 bp, Homo sapiens
  misc_feature: GZ8MTXP01CTUDN.52.8.A08.1.454.CMB.2.raw
  modified_base (191)..(191): a, c, t, g, unknown or other
  misc_feature (191)..(191): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (486)..(486): a, c, t, g, unknown or other
  misc_feature (486)..(486): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggtttcctcgttgctcttttaagaggtgtccagtgtcaggtncagctggtggagtcgtgggggagcgtggtccagcctgggagtccctgagctctctgtgcngcctntggattcaccttnagggtctatgacatgcacgtgggtccncaggcctccgaggcaagggggctggagtgggngctaggtatagtcattaangaagtcggaaagcaaagntatactagtgtagacgtcgtgaaacgggtcattccatcgatctaccganacgacaaactcgaagaaccagctntatctgaccaatgaacnggnttagganagcgtagacgttacacgggtntaggtaatacttacgttgtcgaacgttaaac

SEQ ID NO: 306519 - DNA, 510 bp, Homo sapiens
  misc_feature: GZ8MTXP02IZH8A.52.8.A08.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (497)..(497): a, c, t, g, unknown or other
  misc_feature (497)..(497): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtccctgagactctcttgngcagcctntggattcaccttnaggtctatgacatgcacgtggggcccnccaggcctccgagggcaaggggctgggagtggggtgcctagttatatcaatatgagtgggaaacncaaagataatactatagtagactccgagaagggccattcatcatcncagagacaactccgaagaacacgctgtactcgtagacaaatgaaacaggctagagagctagaagacgacggctagtactattacngtacgacgttaaa

SEQ ID NO: 306520 - DNA, 548 bp, Homo sapiens
  misc_feature: GZ8MTXP02GIJLP.52.8.A08.1.454.CMB.2.raw
  modified_base (157)..(157): a, c, t, g, unknown or other
  misc_feature (157)..(157): n is a, c, g, or t
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
  modified_base (416)..(416): a, c, t, g, unknown or other
  misc_feature (416)..(416): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggtttccncgttgctcttttaagaggtgtccagtgtcaggtgcagctggtggagtctgggggagcgtggtccagccgtgggagtccctgagactctcttgtgcagcctctggattccaccttcagggtctatgacatgcacgtgggtcccncaggcctccgagggccgaaggggctgggaggtggggtggcctagttanatcgatatgatgggaagcaagatatactatagtagactcgtagaacgggccgtattcattccattccnccgaaggacaaccaacgtaccgacggaacacgctagtatactagacaaagtcgaaacagggtccaggaacgaagccgtagaaacgacaccgggtctaggtaacttagttacgtagtacggtacgttaaaacg

SEQ ID NO: 306521 - DNA, 554 bp, Homo sapiens
  misc_feature: GZ8MTXP02G4I80.52.8.A08.1.454.CMB.2.raw
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(271): a, c, t, g, unknown or other
  misc_feature (268)..(271): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcgtggtttcgcgtaggctctttaagaggtgtccagtgtcaggtgcagctggtggagtgtgggggagcgtggtccagcctgggagtcctgagctctntgngcanctntgntcnctcgngtntnnnngcncgtcggcgcngcncgngcgaggngngngtggtgcgtagtatatatatatagngtagagacgaagtataatatagtagtagtacgtacgtaggaacggacgtacgtactactactactactacgaacgaacgaacgtaacgtaaccgaacgaacgaaccgtacgtacgtactacgtacgtaacgtaaacgtaacgaacgaacggtacgtaggaacgaagacgtacgaacgaacgacgtaacgtacgttaacgttacgttacgtacgtacgtaacgtaaacg

SEQ ID NO: 306522 - DNA, 579 bp, Homo sapiens
  misc_feature: GZ8MTXP02HCS0X.52.8.A08.1.454.CMB.2.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctnttgtgcagcctntggattcacctttcaggtctatgacatgctactcggggtcccnccaggtcctccgagggcgaaggggctgggagtggggtgactagttatagtcatagtagagtcgggaaanactaaagtataatacgtagtagtacgacgtacgaggaacggctatcactcatacctacgaagacgaactaacgtaccgaacgaacgacgtcgttagtactacgtaacgaaactaaagtacgaaacgtacggtactagaacgacgtacgtaacgaaacgacgacgtaagttagtaacgttacgtacgtacgtacgtaacgtaaacg

SEQ ID NO: 306523 - DNA, 540 bp, Homo sapiens
  misc_feature: GZ8MTXP02GKFT1.52.8.A08.1.454.CMB.2.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
tcagcgcagtacgacacgaccggtgctcgatttagcatactctacaggggagctctgggagaggagccagcactagaagtcggcggtgcttccattcggtgatcagcactgaacacagaggactcaccatggagtttgggctgagctgggttttcctgttgctctttaagaggtgtccagtgtcaggtgcagctggtggagtcgtgggggagcgtggtccagcctgggagttccngagactctcttgtgcagcctctggattcaccttcagggtctatgacatgcacgtggtccnccaggctccgaggcaaggggctggagtgggtgctagttanatcatatgagtggaacganaagtataatactagtagtagtacgtcgtaggaacggcgtatcatcatcgtacaagacaacaacgtaccgaagaaccacgtctagtactacgtagaacaaagtagaaacgtacggtactaggacgacgacgtaacgaacgacgacgtaacgtacgtaactacttacgtacggtacgtaacgtaaacg

SEQ ID NO: 306524 - DNA, 494 bp, Homo sapiens
  misc_feature: GZ8MTXP02HYPT2.52.8.A08.1.454.CMB.2.raw
  modified_base (192)..(192): a, c, t, g, unknown or other
  misc_feature (192)..(192): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtncagctggtggagtcgtgggggaggcgtggtccaggcctggggaggtccctgagactctcttgtgcagcctctggattcacctttcagggtctatgacatgcactggggtccnccaggctccgagggcaaggggctggagtgggtgccagttanatcatatgntggaagcaagatatactatgtagactcgtgaaggccgattcatcatcncagagacactccgagaacacgctgtatctagacaaagtcgaacagggctagacgagctgaaacgcacggctgtactatactgtgacgtaaac

SEQ ID NO: 306525 - DNA, 604 bp, Homo sapiens
  misc_feature: GZ8MTXP02IDZBR.52.8.A08.1.454.CMB.2.raw
  modified_base (386)..(386): a, c, t, g, unknown or other
  misc_feature (386)..(386): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtcctgagactctcttgtgcagcctctggattcacctttcaggtctatgacatgctacgtcggggtcccgccgaggcctcccgagggccgtaaagggggctggggaggtggggtggaccctagtttactatcaagttatggagtaggggaaanacgtaaaagtataataacgttagttagtacgaccgtcggtaggaacgggcctattacatctactccaccgagacgaacctaacgtaccgaacgaaccacgtcgtagtactacgtacgaactaaacgtacgaaacgtacggtactaggaacgacggacgtaacgaacgacgacggtaacgttagttaacttacgttacgtacggtacgtaacgtaaacg

SEQ ID NO: 306526 - DNA, 516 bp, Homo sapiens
  misc_feature: GZ8MTXP02IZGBD.52.8.A08.1.454.CMB.2.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcttgtgcagcctnggattcaccttcaggtctatgacatgcacgtgggtccnccaggctccgaggcaaggggctggagtgggtgccagttanatcatatgagtggaaacgcaaagntaatactanagtagactcgtagaaagggccattcaatcaatcacaaganacaaactccgaagaactacgactntactntaganaanagaacgacgagagagagacgacgaacgaacgacgaacgtagtaatacttagtacgtacgtacgtaacg

SEQ ID NO: 306527 - DNA, 551 bp, Homo sapiens
  misc_feature: GZ8MTXP02IK75N.52.8.A08.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcttgtgcagcctntggattcaccttnaggtctatgacatgcacgtcgggccnccaggcctcccgaggcgaaggggctggaggtgggtgcctagttantcgatatgagtgggaaancaaagtataatactatagtagacgtcgaggaacggcgtattcgatcaatcctaccagacgaacctaaccgtacgaacgaacgaccgtactagtactacgtagaactaaagtagaaccgtacggagtgaagtacgacgtaaggaacgtaccgagtcgtagtaacttagtacgtagtacgtaacgttaaacg

SEQ ID NO: 306528 - DNA, 538 bp, Homo sapiens
  misc_feature: GZ8MTXP02JV2KY.52.8.A08.1.454.CMB.2.raw
  modified_base (193)..(193): a, c, t, g, unknown or other
  misc_feature (193)..(193): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (459)..(459): a, c, t, g, unknown or other
  misc_feature (459)..(459): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgctcttttaagaggtgtccagtgtcaggtncagctggtggagtcgtgggggagcgtggtccagcctgggacgtccctgagactctnttgtgcagcctntggattcaccttnaggtctatgacatcgcacgtggggtcccncgaggcctccgagggccaaggggctgggagtggggtggccctaggttatatcattagngatagggaaacgnaaagatataactatgtagaacgtcggtaggacggcgtattcattcatctccagacgaacaccgtacgagtaaccacgctagtacncgtacgacaaagtcgaaactaggctaggagagacgtagaacgaccgaggtctaggtattagtactcgtagacgttaaac

SEQ ID NO: 306529 - DNA, 629 bp, Homo sapiens
  misc_feature: GZ8MTXP02I6B4R.52.8.A08.1.454.CMB.2.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtncagctggtggagtcgtgggggagcgtggtccagccgtgggagtccctgagctctctgtgcagcctctggattcaccttnaggtctatgacatgcacgtgggtcccncgaggcctccgagggcaaggggcctggggagtggggtgccctagttatatcgatagttgatagggaagtcaaagattaatacttatagtagaccgtccgtaggaaacgggtcccgtaatttccagttacatcctaccaaaggacgaaccaaccgttaccgaacgaacgtaaccgccttaggtactcgttacggacctaaaagttcgaaaaccgtaggacgttaggaacgaaacggtaccgttaaggaaacggtaccgaaacccggggttaacgttaacggtttaaacgtttaacgtttacggttacggttacgtaaacccggtttaaaacg

SEQ ID NO: 306530 - DNA, 597 bp, Homo sapiens
  misc_feature: GZ8MTXP02HW5HU.52.8.A08.1.454.CMB.2.raw
  modified_base (192)..(192): a, c, t, g, unknown or other
  misc_feature (192)..(192): n is a, c, g, or t
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtncagctggtggagtcgtgggggaggcgtggtccagccgtgggagtccctgagctctcttgtgcagcctntggattccacctttcaggtctatgacatgccacgtcggggtcccnccaggcctccgagggcgaaggggctgggaggtggggtgcctagttatatcgaatagtgagtcggggaaanacgaaagtaattattaacgtagtagtaacgtaccgtacggtaggaacgggtcgtattcatctacttccaccgaagaacgaaccgaacgtaccgaacgtaaccgacgtactagtactcgacgaactaaagtacgaacgacggtacgtaggaacgacgtacgtaaggacgaaccggacggtaacttacgtaacgttacgttacgtacggtacgtaacgtaaacg

SEQ ID NO: 306531 - DNA, 566 bp, Homo sapiens
  misc_feature: GZ8MTXP02IIEEL.52.8.A08.1.454.CMB.2.raw
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcttgngcagcctctggattccaccttcaggtctagtgacatgcacgtggggtccnccgaggcctccgaggcaaggggctgggagtggggtggcctagttatatcatagtgagtgggaancgaaagtatagtaactagtagtaagtaccgttaccggtaggaaacgggcccgtaatttccaatcatcctacagaacgtaaccaaccgtccgaagaaccgacgtactgtactctacgacaaaatgaaacgtaggactgaaggacgtacgaacggaaacgacgacggtaattagttaatacttacgtaggtacgaacgtaaac

SEQ ID NO: 306532 - DNA, 555 bp, Homo sapiens
  misc_feature: GZ8MTXP02HGP9C.52.8.A08.1.454.CMB.2.raw
  modified_base (174)..(174): a, c, t, g, unknown or other
  misc_feature (174)..(174): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (490)..(490): a, c, t, g, unknown or other
  misc_feature (490)..(490): n is a, c, g, or t
  modified_base (524)..(524): a, c, t, g, unknown or other
  misc_feature (524)..(524): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagnggtgtccagtgtcaggtgcagctggtggagtcgtgggggagcgtggtccagcctgggagtcctgagctctcttgngcngcctntggattcaccttcgaggtctatgacatgcacgtcggggtccncaggcctccgagggcgaaggggctggggaggtggggtgacctagttatatcatangactgggaaancaaagtatagtactatgtaagacctcggtaggaacgggtcctattaccaatctaactcctaccgaagacgtacaacgtaccgaagaaccgacgtcgtagtactcgtgaactaaaagtgaaaacgnggtacaggacgacgtacgacgaacgacgacggtntagtactacgttacgtcgtacgtaactaacg

SEQ ID NO: 306533 - DNA, 554 bp, Homo sapiens
  misc_feature: GZ8MTXP02GFLNY.52.8.A08.1.454.CMB.2.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcttgngcagcctctggattcaccttnagggtctatgacatgcacgtgggtcccncaggctccgaggcgaaggggctgggagtggggtgctagttatatcatatagcgtagggaanacaaagtataatactatagtagtacctcggtagacgggccgtatacatcatcaccaagacgaacaaccgtacgaacgaacacgtactagtactcgtagtaacaaagtacgaaacgacggtactaggaacgagacgtacggaaacgacgaacggtcttaaggtaacttattacgtggtacgaacgttaaaacg

SEQ ID NO: 306534 - DNA, 547 bp, Homo sapiens
  misc_feature: GZ8MTXP02F7GTP.52.8.A08.1.454.CMB.2.raw
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttggctgagctgggttttccctgttgctcttttaagaggtgtccagtgtcaggtgcagctggtggagtcgtgggggagcgtggtccagcctggggagtcctgagctctcttgngcagcctctggattcaccttcgaggtctatgacatgcacgtcgggtccnccaggcctccgagggcgaaggggtctgggagtggggtgcctaggtttanagtcaattagtgacgtgggaaancgaaagattaatactagtagtagtacgtacgtaggaaggacgtatcatcactactacagacgaacaactaccgaacgaacacgactagggtactacgtacgacaaatagaacgaggactagacgagacgtagaacgacgacgtaagtagtaattacttactagtacgtacgtaaacg

SEQ ID NO: 306535 - DNA, 561 bp, Homo sapiens
  misc_feature: GZ8MTXP02G33XJ.52.8.A08.1.454.CMB.2.raw
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (541)..(541): a, c, t, g, unknown or other
  misc_feature (541)..(541): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtcctgagctctctgtgcagcctctgattcaccttcgaggtctatgacatgcacgtggtcccncgaggcctcgaggcgaaggggctaggnggtgggtgctagttacatcagtangagtcggaaancaagatatactatagtagacgtcgaggacggccgtattcatcactactaccgaagacgaacaacgtaccgaagaaccacgtctagtacttacgacgaactaaaagtcgaaaaccgtaggtaccgaggaacgacgtacgaagaaacgtacggaccgtaagttagtaaacttagttaacgnggtacgtaaccgttaaaacg

SEQ ID NO: 306536 - DNA, 556 bp, Homo sapiens
  misc_feature: GZ8MTXP02GZNWZ.52.8.A08.1.454.CMB.2.raw
  modified_base (262)..(262): a, c, t, g, unknown or other
  misc_feature (262)..(262): n is a, c, g, or t
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtcctgagactctcttgtgcagcctntggattcacctttgaggttctagtgacatgctacgtcggggtccnccgaggctccgagggcgaggggctgggagtgggtgctagttatatcatagtgagtaggaaanacgaaagtattaatactagtgtaacgacgttccgaggaacgggcctattcatacactcaccgagacgaacaaccgtacgaacacacgctagtactcgtagaactaaagcgaaacgacggactaggagacgtacgaggaacgacgacgaagttagtaattacttacgtaggtacgtaaactttaaacg

SEQ ID NO: 306537 - DNA, 560 bp, Homo sapiens
  misc_feature: GZ8MTXP02F8385.52.8.A08.1.454.CMB.2.raw
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctgggtggagtcgtgggggagcgtggtccagcctggggagtccctgagctctcttgngcngcctctggattccaccttcaggtctatgacatgcacgtgggtcccnccaggcctcgagggcaaggggctgggagtggggtgctagttnatcatatgagtggaanacaaagtataatactatgtaacgaccgtcggtaaggacgggtcctattcaactcattccacgaagaacaactaaccgtcgaaacgaaaccgcacgtagtactacgtagactaaagtagaaaccgaggtacaggaacgagtacgagaaacgaccgaacggtaagttagtaatttacgtacgtagtacgtaaacgttaaaacg

SEQ ID NO: 306538 - DNA, 580 bp, Homo sapiens
  misc_feature: GZ8MTXP02I3XEV.52.8.A08.1.454.CMB.2.raw
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (547)..(547): a, c, t, g, unknown or other
  misc_feature (547)..(547): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagttgtcaggtgcagctggtggagtcgtgggggagcgtggtccagcctggggagtccctggagactctcttgngcagcctctggacttcaccttcgaggtctatgacntgcacgtgggccncaggcctcgagggcgaaggggctggggagtggggtgcctagttanatacattagtgagtaggaaagacaaagtattaacgtaatagtagtagtacctccggtaggaacgggtccctagttacactactactaccgtccgaaagaacgtaaaccaaaccgtaccgaacgaaccacgtactagtactcgtacgaacgtaaatgaaacctagggactaggaagtacgactagaaacgcgaacggtntagttataacgttctaggtacgtaacgttaaac

SEQ ID NO: 306539 - DNA, 584 bp, Homo sapiens
  misc_feature: GZ8MTXP02IOXC4.52.8.A08.1.454.CMB.2.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (483)..(483): a, c, t, g, unknown or other
  misc_feature (483)..(483): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggaggtccctgagactctcttgtgcagcctcnggattcaccttcagggtctatgacatgcacgtgggtccnccaggcctccgagggctaaggggctgggaggtggggtgcccaggttatagtcaattatgagtgggaaacgcaaagtaattagtaacttaatagttaagaaccgttccggtaggaaacgggtcccgtatttccaattccaaatcctaaccaggaaacaacgaaccttaccgaagaaccaacgntacgtaattccagacctaaagtacgaaacgagggcaggacgaagcgtagaaacgaccgacgggcgttataacttattaacgtgttacggtaacttaaaacg

SEQ ID NO: 306540 - DNA, 732 bp, Homo sapiens
  misc_feature: GZ8MTXP02F3H1I.52.8.A08.1.454.CMB.2.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
tcagcgcagtacgacacgaccggtgctcgatttagcatactctacagggggggagaggagcccagcactagaagtcggcggtgcttccattcggtgatcagcactgaacacagaggactcaccatggagtttggctgagcgtggtttcctcgttgctcttttaagaggtgtccagtgtcaggtgcagcgtgggtggagtcgtgggggagcgtggtccagccgtgggacgtccctgagactctcttgngcagtcctgtggtacttccaccgttcgaggtctatgacatgcagtcggggtcccncgaggcctaccgaggaccgaagggggctaggggaggtgggggttagacgtagtttaatataccgtaatagtgaaacgtggaaaagactaaggtattaagtaacgttagttcgtaaagtacccgttacggtaagggaaaccggggtccctaaagtttacaacttctaaacttcccgtaaccgaaaggaacaaaaccgtaaccgtaaaccggaaacggtaaaccaacggtcctagtttaaacgaccgttaaaacgaaacgtaaacgtaaacgtaaacggtaacggtaacgtaacggtaacggtaacggtaacgtaaacggtaaacggtaaaccggtaaccggtacgttaacgtttaacgttaacgttaacgttaacggttaacggttaaaccgttaaaaccgttaaacgtaaaccggtaaacgggtaaacgg

SEQ ID NO: 306541 - DNA, 545 bp, Homo sapiens
  misc_feature: GZ8MTXP02JTVB5.52.8.A08.1.454.CMB.2.raw
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
  modified_base (483)..(483): a, c, t, g, unknown or other
  misc_feature (483)..(483): n is a, c, g, or t
  modified_base (512)..(512): a, c, t, g, unknown or other
  misc_feature (512)..(512): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttccncgttgcttcttttaagnggtgtccagtgtcaggtgcagcgtggtggagtcgtgggggagcgtggtccaggccgtggggacgtccctgagtactctcttgtgcacgcctcnggtattcaccgttgaggtctatgacatgactacgtcgggccncgaggcctccgagggcgaaggggctgggaggtggggtgacctagttacntcagtagtgacgtagggaaanacgaaagtataatacttatagtacgactacggaggaacggcgtagttcattcatcacagactacactccgagacacgntagtatctacanaagtagaacggngtgtagagagacgacgaacgacgtacgtnttaagtacttagtacgtacgtactacgtaaacg

SEQ ID NO: 306542 - DNA, 605 bp, Homo sapiens
  misc_feature: GZ8MTXP02HURPZ.52.8.A08.1.454.CMB.2.raw
  modified_base (173)..(173): a, c, t, g, unknown or other
  misc_feature (173)..(173): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (381)..(381): a, c, t, g, unknown or other
  misc_feature (381)..(381): n is a, c, g, or t
  modified_base (513)..(513): a, c, t, g, unknown or other
  misc_feature (513)..(513): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctggttttcctcgttgctcttttaagnggtgtccagtgtcaggtgcagctggtggagtcgtgggggaggcgtggtccagccgtggggacggtccctgagctctcttgngcagcctctggtattccgaccttcgagggtctatgacatggcacgtggtccncctaggcctccgagggcgaaggggctgggaggtggggtggccgtagtttatatcgtattagtgtagtagggaaanacgaaagtaataactaacttagtacgtaacgtaccgtacggtagggaacggggtaccttagttactacgtctacttccacgaagaccgtaacctaaccgtaccgaacgaaccgaccgtctacgtactcgtanaactaacgtacgaacgacgtacgtagacggacgacgtacgaacgaacgacgtaacgtagtaacgttacgttacgtacgtacgtaacgtaacg

SEQ ID NO: 306543 - DNA, 566 bp, Homo sapiens
  misc_feature: GZ8MTXP02JIG1A.52.8.A08.1.454.CMB.2.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcttgngcngcctctggacttcaccttcaggtcctagtgacatgcacgtggccncaggctccgaggcgaagggctgggaggtgggtgaccgtagttanatcgatacngtagtggaaacgtcaaagtataagtactagtgtatacgttccgtaggaacgggccgtattccgaatctactccgtaccgaagtacgaacctaacgtaccgaacgaacacgtctagtactctagaactaaagacgaaaccggagccgtagagacgcgtaagaagacccgaggtctaaggttactaattcggtaagtacgtacgttaaaaccg

SEQ ID NO: 306544 - DNA, 573 bp, Homo sapiens
  misc_feature: GZ8MTXP02IQS3H.52.8.A08.1.454.CMB.2.raw
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctgggtggagtcgtgggggagcgtggtccaggccgtggggagtccctggacgctctcttgtgcagcctntggattccaccttnaggtctatgacntgctacgtcgggcccncgaggcctccgagggcgaaggggctgggnggtgggtgacctagttanatcatagtgagtggaacacaaagtataatactagtacgtagaccgttcgaggtaacgggtccctattaccatctactcgacgaagaacgaaaccaacctccgaataaccgacgtctagtactcgtagactaaagtgaaacgcggacgtaggacgtacgacgtaacgaacgacgacgtaacgtagttaacttacgttacgtacgtacgtaacgtaaacg

SEQ ID NO: 306545 - DNA, 565 bp, Homo sapiens
  misc_feature: GZ8MTXP02GML1Y.52.8.A08.1.454.CMB.2.raw
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctggggttttccncgttgctcttttaagnggtgtccagtgtcaggtgcagctggtggagtcgtgggggagcgtggccagcctgggagtcctgatactntctgngcagcctctggattcacttnaggtctatgacatgcacgtggtccnccaggtcctccgagggcgaaggggctggggacggtggggtcgccgtacgttagtatcatacgtgagtggaaagcgaaagtataatactatagtagtactcgtagaacgggccgtatacgatcatctacaaggtcgaacgacgtaccgaagaacgacgacgtagtatcgtacgactaaagtacgaactacggaccttaggaacgtacgtacgaacgaacggacgtacggtaactacgtaaacgttacttaccgtagtacggtacttaaaacg

SEQ ID NO: 306546 - DNA, 600 bp, Homo sapiens
  misc_feature: GZ8MTXP02IV5UN.52.8.A08.1.454.CMB.2.raw
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctggggagtcctgagactctcttgtgcagcctcgtggacttccacctttgagggttctatgacatcgctacgtcggggtccccncaggtcctccgagggcgaaggggctgggaggtggggtgctagttatatcatatgngtaggaancaaagtatatactatagtagaccgtcggtaggaacgggtccctattcgattcaacttccgaccaaagacgaaccaacgttacccgaaagaaccacgacttagttaatccgtagaacaaaagtcgaaaacgtacggagtaggaaaggtacgtacgtagggaaacgaccgtacgggtaacttaaggttaactttaacgttaccgtaggtacgtaaccgtttaaaacg

SEQ ID NO: 306547 - DNA, 749 bp, Homo sapiens
  misc_feature: GZ8MTXP02IBY0G.52.8.A08.1.454.CMB.2.raw
  modified_base (193)..(193): a, c, t, g, unknown or other
  misc_feature (193)..(193): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagctgggttttcctcgttgcttcttttaagaggtgtccagtgtcaggtncagcgtggtggagtcgtgggggaggcgtggtccagccgtgggagtccctgagctctctgtgcagcctnggattccacttgaggtctagtgactatcgctacgtcggggtccccnccgtagggcctaccggagggaccggaaggggcgtaggggaggttggggtacggccgtaaggtttataagtcaagttagttaggacgttaaggggaaacgtaaccgaaaagttacttaaataaaccgttaagttacgggttaaacgaccggttaaccccgggtaaggaaacccgggggtaaccccttagttttacccaattaccctaaacggttcccctacgtaaacggaaaccggttaaaacccaaacccgttaccggaaaccggttaaaccaaccgggtcccttaaggtaactttccgaaggttaaacctaaaaggtacgaaaacccgtagggacccttaagggaaagtaaccgtacgtaacgaaaccggtaacccggaacggtcgtttaacggtaattaaccgtttaacggtaggtttaaccgaaaacggtttaaaaccg

SEQ ID NO: 306548 - DNA, 586 bp, Homo sapiens
  misc_feature: GZ8MTXP02JU1SI.52.8.A08.1.454.CMB.2.raw
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtggggacgtcctgagtctctcgttgtgcagcctcgtgacttcaccttcgagggtctatgacatcgctacgtcgggtcccaccgaggcctccgagggaccggaacgggggctaggggaggtggggtcggaccgtagtttacattctatattggagtagggaaagcaaagtataattactagtagtacgactccggtaggaacggtccgtattccgatcctatcctacgaagtacaacgaaccgtacgaacgacacgactgtactacgtgacaaagtacgaaacgacggtacgagacggacgagtacgaacgaccgacgtcgtaggtaacttagtacttaggtacgaaccgttaaacg

SEQ ID NO: 306549 - DNA, 507 bp, Homo sapiens
  misc_feature: GZ8MTXP02IU6QE.52.8.A08.1.454.CMB.2.raw
  modified_base (176)..(176): a, c, t, g, unknown or other
  misc_feature (176)..(176): n is a, c, g, or t
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagnggttgtccagtgtcaggtgcagctggtggagtcgtgggggagcgtggtccagcctgggacgtcctgagactntcttgtgcagcctntggattcacttnaggtcatgacatgcacgtcggtcccgcaggcctcgaggcgaaggggctggggagtgggtgcctagttactatcatatgagtaggaaagcaagatatactatagtanctcgtagaggtctatcatcatctcaganacaactcganacacnctgtactganacaaatcgaacacggctagacgagacgtacgaagaacgacgngttagtaattactcgtacggtagaacttaacg

SEQ ID NO: 306550 - DNA, 673 bp, Homo sapiens
  misc_feature: GZ8MTXP02HE74G.52.8.A08.1.454.CMB.2.raw
  modified_base (170)..(170): a, c, t, g, unknown or other
  misc_feature (170)..(170): n is a, c, g, or t
tcagcgcagtacgacacgaccggtgctcgatttagcatactctacagggggggagaggagcccagcactagaagtcggcggtgcttccattcggtgatcagcactgaacacagaggactcaccatggagtttgggctgagcttgggttttcctcgttgcttcttttaagnggtgtcctagtgtcaggtgcagcgtggtggagtcggtgggggagcgtggtccaggccgtgggacgtccctgacgtactctctgtgcacgcctcgtggacttcctccttcgagggtctatggaactagtcgccgtaccgtcggggtccccgccggaacggtcccgtacccggaagggacgggaaacggggtcgttggggaggttggggtcggacgttaagttatataccctaagttagtaggtaagtagggaaactagaagtaattaatactagttagtaacgacgtccggtaggaacggtccttaaatctattcaacttcctaccgaacgtaacgaccaaccgtaccgaaacgtaaccgacgtcttaagtactacgtacaaacaagtaacgaacgtaggctaggagtaacgacgtaaagaacgacggtacgacgttagttaattaacgtaagtacgtaacgtaaccgttaaacgtaccggtaaacggaccggtaaaaccgggg

SEQ ID NO: 306551 - DNA, 623 bp, Homo sapiens
  misc_feature: GZ8MTXP02JU2CE.52.8.A08.1.454.CMB.2.raw
  modified_base (263)..(263): a, c, t, g, unknown or other
  misc_feature (263)..(263): n is a, c, g, or t
  modified_base (385)..(385): a, c, t, g, unknown or other
  misc_feature (385)..(385): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagtctctcttgtgcagcctntggattcgacctttgaggtctagtgacatcgcctacgtcggggtccccacgaggcctcccgagggcgaaggggctggggaggtggggtgacctaggttatatacatagtgacgtagggaaancgaaagataactacttagtagtagtaccgtcggtaggaaacgggcctattcacttcaattccgacagacgaaaccacgtaccaagaacgaccgtacttagtacttacacgaacctaaagaccgaaaagtacgggaccttaggaaaccggaagtaccggtaagaaaccggtaacgaaccgggtaacttaggtttaaacttaccgttttaacgaggtttacgaaaacggttttaaacccg

SEQ ID NO: 306552 - DNA, 701 bp, Homo sapiens
  misc_feature: GZ8MTXP02JFZ7G.52.8.A08.1.454.CMB.2.raw
  modified_base (177)..(177): a, c, t, g, unknown or other
  misc_feature (177)..(177): n is a, c, g, or t
  modified_base (274)..(274): a, c, t, g, unknown or other
  misc_feature (274)..(274): n is a, c, g, or t
  modified_base (322)..(322): a, c, t, g, unknown or other
  misc_feature (322)..(322): n is a, c, g, or t
  modified_base (590)..(590): a, c, t, g, unknown or other
  misc_feature (590)..(590): n is a, c, g, or t
tcagcgcagtacgacacgaccggtgctcgatttagcatactctacaggggagctctgggagaggagcccagcactagaagtcggcggtgcttccattcggtgatcagcactgaacacagaggactcaccatggagtttgggctgagcttggggttttcctcgttgcttcttttaagnggtgtccagtgtcaggtgcagcgtgggtggaggtcggtggggggaggcgtgggtccaggccgtggggagtccctgagcttctcttgtgcagcctcgnggtacttcacctttcgaggtctatgacagtgcctacgtcggggtcccnccgaggtccctccggaaggggccgtaaagggggccgttaggggtacgggttgggggtcggtaccgtaggttttaactagtacgtaattaagttgggaattagggggaaagacgtaaaagtaattaaacgtttaacgttaagttacggtaaacggtacccgtttacccggggttaaggaaaacggggtcccgtaatttaccgtaattaccaacttcctaacccgaaagaaacggaccctaaacctaccgggaaacgaaccgtaccggtnttagtaactcgtaaggactaaagtagaacgaggtcgtaggacgtacgacgtacggaacgaccgagggtcttaggttaacttacgttagtacggttagaaaccggtttaacg

SEQ ID NO: 306553 - DNA, 605 bp, Homo sapiens
  misc_feature: GZ8MTXP02JDFIX.41.1.A01.1.454.CMB.2.raw
tcagtctatactatcacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtatgatatcgtggttgctggtatcagcagaaaccgaggaactcgacccctaaggtcctagactctaataagggcttagttaagttaaggaaaagggtcggggtaccctagtacgtaaggttcgaggccggacgtaggtaggaacttcggtagggaactaggtaacttccaaccttctaccaactatcagcacgcctggcaggtcctagattacgtatttacgacttaaactttattacctacgtacctaaataggtaataaagttagtttactctacgtaggttacgttcggacgtaaggggacctaaaggcgtaagggaaactacgtaaaccgaaaacggttaacgtcgggtacgtacgtacggacctaactacttcgtttacg

SEQ ID NO: 306554 - DNA, 535 bp, Homo sapiens
  misc_feature: GZ8MTXP02HDI0N.41.1.A01.1.454.CMB.2.raw
  modified_base (384)..(384): a, c, t, g, unknown or other
  misc_feature (384)..(384): n is a, c, g, or t
tcagtctatactatcacgaccggtgctcgatttagacgtctcatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtatgatatctggttggctggtatcagcaagaaaccagggaatcgacccctaaggtcctgactctaataaggcgtacttaggttaagaaaggtcggggtacccagtacgtaaggtcaggccggacagtggatcgagggacagattcactctcacatcagcacgcngcagcctagatgttatttgacttagtttattactgttacagtctaagtagtagtgacgtcggtaccttccgttactaccggtttccgcccggttaggaccctagtacgtacgtacttacgaaacgtaacgtaggtcgactgacacctcttc

SEQ ID NO: 306555 - DNA, 420 bp, Homo sapiens
  misc_feature: GZ8MTXP01E13WG.25.79.H02.1.454.CMB.2.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (402)..(402): a, c, t, g, unknown or other
  misc_feature (402)..(402): n is a, c, g, or t
  modified_base (408)..(420): a, c, t, g, unknown or other
  misc_feature (408)..(420): n is a, c, g, or t
tcagactgtacagtcacgaccggtgctcgatttagtgtcacacgaagggaaaggggctggagtggattgggagtgtcgcttatagtgggaccacctactacaacccgtccctcaagagtcgattcaccatatcagtggacacgtcccagaaccagttctccctgaagttgaatttttgtgaccgccgcggacacggccctatattattgtacggcgagggcgacagcagatggtggagcaagtgactggggccaggggaaccctggtaaccgtctcctcaccttccacaaggccancggtctcccctgcncctncctcagncacctgnggggcacngcgcccgtggctgcctggtcaggacctacttcactgacaagtctggacgcgggctgggcaagggcncatagnnnnnnnnnnnnn

SEQ ID NO: 306556 - DNA, 451 bp, Homo sapiens
  misc_feature: GZ8MTXP01C0JEQ.25.79.H02.1.454.CMB.2.raw
  modified_base (329)..(329): a, c, t, g, unknown or other
  misc_feature (329)..(329): n is a, c, g, or t
  modified_base (434)..(451): a, c, t, g, unknown or other
  misc_feature (434)..(451): n is a, c, g, or t
tcagactgtacagtcacgaccggtgctcgatttagtgtcacacgaagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactgggggccaggggaaccctggtaaccgtctcctcaccttccaccaacgggcccatcggtcttccccctggccgccctcgctccnggacgcacctcgtcgggggccacgaggccggcccgtgggctcgccgtggtcaaggtacctactcactcgtacaacgtctgagcgggctggacaagggcacatagnnnnnnnnnnnnnnnnnn

SEQ ID NO: 306557 - DNA, 420 bp, Homo sapiens
  misc_feature: GZ8MTXP02G8X24.25.79.H02.1.454.CMB.2.raw
  modified_base (419)..(420): a, c, t, g, unknown or other
  misc_feature (419)..(420): n is a, c, g, or t
tcagactgtacagtcacgaccggtgctcgatttagtgtcacacgaagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactgggggccagggaaccctggtaaccgtctcctcacccttccaccaagggccccatcggtcttccccctggcgcccctgctccaggagcacctctgggggcacagcggccctgggctgcctggtcaaggacctacttccactgtacagtctgagcgggctggcaaggcgcatagnn

SEQ ID NO: 306558 - DNA, 410 bp, Homo sapiens
  misc_feature: GZ8MTXP02HUTN9.25.79.H02.1.454.CMB.2.raw
  modified_base (308)..(308): a, c, t, g, unknown or other
  misc_feature (308)..(308): n is a, c, g, or t
  modified_base (406)..(410): a, c, t, g, unknown or other
  misc_feature (406)..(410): n is a, c, g, or t
tcagactgtacagtcacgaccggtgctcgatttagtgtcacacgaagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactggggccagggaaccctggtaaccgtctcctcacttccaccaaggcccatcgtctcccctgcnccctgctccaggagcacctctggggcacagcggccctgggctgcctggtcaaggcctacttccactgtacagtctgagcggctggcaaggcgcatagnnnnn

SEQ ID NO: 306559 - DNA, 432 bp, Homo sapiens
  misc_feature: GZ8MTXP02GQ6N9.25.79.H02.1.454.CMB.2.raw
  modified_base (426)..(432): a, c, t, g, unknown or other
  misc_feature (426)..(432): n is a, c, g, or t
tcagactgtacagtcacgaccggtgctcgatttagtgtcacacgaagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactgggggccagggaaccctggtaaccgtctcctcacccttccaccaacggcccatcggtcttccccctggcgccctgcctccaggagcacctcgtgggggcacgacggcggccccgtggggctggccgtggtcaggacctacttccactgtacagtctgagcgggctggcaaggcgcatagnnnnnnn

SEQ ID NO: 306560 - DNA, 542 bp, Homo sapiens
  misc_feature: GZ8MTXP01APZJT.15.16.B05.1.454.CMB.2.raw
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcctgttagctatttagaaggtgtccagtgtgaggtgcaactggtggagtctgggggaggcctcgtccagccggggggtccctgagactctcctgtgaagcctctggattcaccttgagcacttattggatgacttgggtccgccaggctccgaggggaaggggctggagtggggtggccaccatacaaaaagngtaggaacgngacactaacctatgtanaactntgtgagtgggctatcaccgtcaccgagacgacgacgaccaaagactcactacatcagacgaatagaacaaccacgagacgacgacgacgacgcgtgtgtaatacttgtgttgagagagttgttcgtgtcggtcgggcggacgggaccgtcgttcgtccg

SEQ ID NO: 306561 - DNA, 546 bp, Homo sapiens
  misc_feature: GZ8MTXP01CM97J.15.16.B05.1.454.CMB.2.raw
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctatttagaagtgtccagtgtgaggtgcaactggtggagtcgtgggggagcctcgtccaggccggggggtcctgagactctcctgtgaagcctctggattcaccttgagcacttatggatgacttggccnccaggctccgagggaagggctggagtggtgccacatacaaaaagntaggaactggacacaacctatgtagaactctgtgatgggccattccgaccgtcnccgagacgacgacgaccaaggaactcgaactacatctagacaaattcgaaactacctgacgtacgccgaaggactacgggtctgtgtaattacgngttacgngagngttagttcgttctgcggttgggccagggaccctggttcctaacccg

SEQ ID NO: 306562 - DNA, 541 bp, Homo sapiens
  misc_feature: GZ8MTXP01EMQWR.15.16.B05.1.454.CMB.2.raw
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (359)..(360): a, c, t, g, unknown or other
  misc_feature (359)..(360): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (455)..(455): a, c, t, g, unknown or other
  misc_feature (455)..(455): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgctatttagaaggtgtccagtgtgaggtgcaactggtggagtcgtgggggaggcctcgtccaggccgggggggtccctgagactctcctgtgaagcctctggattcaccttgagcacttattggatgacttgggtccncaggctccgaggggagggctggagtggngccacgataacaaaagnagacnacacactannanctntgngagtcggctatcactcncagacgacgacgacaanactcactanatcganacaaatacgaaacacgagagacgacgaagactacggtntgtagtaattagttgtgttagagtagttagttcgttcgtgggtcgggtcggggaccgtacggggttacccgtcggttaaccgtccg

SEQ ID NO: 306563 - DNA, 546 bp, Homo sapiens
  misc_feature: GZ8MTXP01A727W.15.16.B05.1.454.CMB.2.raw
  modified_base (348)..(348): a, c, t, g, unknown or other
  misc_feature (348)..(348): n is a, c, g, or t
  modified_base (490)..(490): a, c, t, g, unknown or other
  misc_feature (490)..(490): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggaggcctcgtccaggccggggggtccctgagactctcctgtgaagcctctggattcaccttgagcacttattggatgacttgggtccgcaggctccgagggaagggctggagtgggtggccaccatacaaaagntggaagtgacacaacctatgtagaactctgtgatgggccgattcaccgtctccagacgacgacgccaaagaactcaactacatctagacaaatgaaaccaaccgtagaagacgccgaagggactacgggctgtgtaattacngtgttgagagagttgttctgcggttggggccgacgggaacccgtggccgtaacccg

SEQ ID NO: 306564 - DNA, 618 bp, Homo sapiens
  misc_feature: GZ8MTXP01CIRLI.15.16.B05.1.454.CMB.2.raw
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtcagtgtgaggtgcaactggtggagtctgggggaggcctcgtccaggccgggggggtccctgagactctcctgtgagcctctggattcaccttgagcacttattggatgacttgggcccncgaggctcgaggggagggctggnggtggtgcgacanaacaaagagagagagacacaactatagtagaactctgtgtagtcgggcgtactctaccgtctaccgacgacgaacgaccgaccgaaacgaacctacctaactaactaactactacgaacgaaactaacgaaaccaaaccgtaacgaacgaacggaccggaacggaaccgtacggtacgtcgttgttaagtttacgttagttgttaggtaggtagttagttcgttcggttggtcgggttcggggtaccgggtaccgggttacccggtccggttccgtaacccg

SEQ ID NO: 306565 - DNA, 539 bp, Homo sapiens
  misc_feature: GZ8MTXP01DJGAJ.15.16.B05.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccnccaggctccaggggaggggctggagtgggtggccaccatacaaaagntaggaagtgacacaacctatgtgaactctgtgatgggccattcaccgtctccagagacgacgaccaagaactcactacatctgacaaatgaaacaacctgagagccgaagacacggctgtgtaattacttgtgttgagagagttgttctggcggttgggggccagggggacccctgggttcctaacccg

SEQ ID NO: 306566 - DNA, 536 bp, Homo sapiens
  misc_feature: GZ8MTXP01EFXFS.15.16.B05.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccncaggctccgaggggagggctggagtgggtgccacatacaaaagntggaatgacacaacctatgtgaactctgtgatggggccattcaccgtctccagagacgacgaccaaagaactcactacatctgacaaatgaaacaacctgaagagccgaggacacgggctgtgtaattacttgtgttgagagattgttctggtcggttggggccaggggaccctgggttcctaacccg

SEQ ID NO: 306567 - DNA, 559 bp, Homo sapiens
  misc_feature: GZ8MTXP01DLVO2.15.16.B05.1.454.CMB.2.raw
  modified_base (354)..(354): a, c, t, g, unknown or other
  misc_feature (354)..(354): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaggggctggagtgggtggccaccataacaaaagntaggaagtgacacaacctatagtagaactctgtgagtggggccattccaccgtctaccagagacgacgaccaaagaactcaactacatctgacaaatagaaaccaacctgaagacgaccggaggacacgggctgtgtaattacngtgttgagngttagttgttcnggtcggttcggggccacggggaccctgggttcctaacccg

SEQ ID NO: 306568 - DNA, 578 bp, Homo sapiens
  misc_feature: GZ8MTXP01EVLN8.15.16.B05.1.454.CMB.2.raw
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttatggatgacttggtccgcaggctccgaggggagggctggagtggnggccacataacaaaagntaggaagtgaacacaaacctatagtagaactctgtgagtcggggccgtattccaccgtctaccaagacgacgacgaccaaagactcaactacatctagacaaatcgaaacaaccgtagagacgaccgaggacacgggtctgtgtaattagttggtgttggagtagttagttgttcgtggtacgggttcggggacccgtaacggggttacccctcgggttcctaaccccgg

SEQ ID NO: 306569 - DNA, 533 bp, Homo sapiens
  misc_feature: GZ8MTXP01DCFLO.15.16.B05.1.454.CMB.2.raw
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgaggggaaggggctggagtgggtggccaccataacaaaaagntaggaagtgacacaacctatgtgaactctgtgatgggccattcaccgtntccagagacgacgaccaagaactcactacatctgacaaatgaaaccactgagagcgaggcacggctgtgtaattacttgtgttgagngagttgttctggcggttggggccagggaccctgggcctaacccg

SEQ ID NO: 306570 - DNA, 549 bp, Homo sapiens
  misc_feature: GZ8MTXP01DC3QN.15.16.B05.1.454.CMB.2.raw
  modified_base (356)..(356): a, c, t, g, unknown or other
  misc_feature (356)..(356): n is a, c, g, or t
  modified_base (505)..(505): a, c, t, g, unknown or other
  misc_feature (505)..(505): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttatggatgacttgggtccgccaggctccaggggaaggggctggagtggggtggccaccatacaaaaaagntaggaaagtgacacgaaacctatgtgaactctgtgatgggccgattcaccgtctcagagacgacgaccaaagactcactacatctgacaaatgaaacaacctgaagacgaccgaaggactacgggctgtgtaattacgttgtgttgagngttagttgttctggcggttggggccagggaccctggctaacccg

SEQ ID NO: 306571 - DNA, 566 bp, Homo sapiens
  misc_feature: GZ8MTXP01EHL41.15.16.B05.1.454.CMB.2.raw
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccgaggccgggggggtcctgagactctcctgtgaagcctctggattcacttgagcattatggatgacttgggccncaggctccgaggggagggctggagtgggtgccacataacaaaaagntggaatgaacacaaacctatagtagaacttctggtagagttcgggggcctaatttccaaccggtctacccaaggacgaccgaacgacccaaagaacctcaactaccgattccagacgaaatagaacaaccagagagcgacgacgacgctgtgtaattaattgtgttgagagagttgttgtgtggtcggggtcggacgggaccgtaacggttcgtaacccg

SEQ ID NO: 306572 - DNA, 545 bp, Homo sapiens
  misc_feature: GZ8MTXP01BN3CE.15.16.B05.1.454.CMB.2.raw
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (396)..(396): a, c, t, g, unknown or other
  misc_feature (396)..(396): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtcctgagactctcctgtgagcctntggattcaccttgagcacttatggatgacttgggtccncaggctccgaggggagggctggagtggngccacataacaaaagntggaacgtgacacaacctatgtagaactctgtgatgggcattcacgtcncagagacgacgaccaagaactcactacatctgactaaatcgaaaccaaccgtgaagacgccgaaggacaacgggctggtgtaattacttggtgttgagtagagttgttctggcggttggggccacggggaccctgggttccctaacccg

SEQ ID NO: 306573 - DNA, 536 bp, Homo sapiens
  misc_feature: GZ8MTXP01AKVLM.15.16.B05.1.454.CMB.2.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcggtggtttcgtgtaggctatttagaaggtgtcagtttgaggtgcaatggtggagtctgggggaggcctcgtccaggccgggggggtccctgagctctcctgtgaagcctctggattcacttgancattntgatgtacgttggccgcgnggcncggagggaggngnggnggnggngcacanaanaaagagagagacgacacactatgtanactntgtgagtggcgtactctacgtctcgagacgacgacgacaacgacacacacactacanacaagacaacaacagagacgacgacgacgacgtgtgtagtattaagtgttgtagagtagtagttgttcgttcggtcgggtcgggtcggacgggtaccgttcgtccgttccgtccg

SEQ ID NO: 306574 - DNA, 589 bp, Homo sapiens
  misc_feature: GZ8MTXP01D5ZBQ.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttatggatgacttgggccgccaggctccgaggggaaggggctggagtgggtcgaccacataacaaaagagtaggaagtgaacaacaacctatagtagaactctgtgagtcggggccgattccgaccgtctaccgagagaccgaccgaccaaagaactcaactaccatcctagaacaaatacgaaaccaaccgtgaacgacgccggaaggaccgtacggctgtgtaattacgttgtgttgagtagttagttggttcgtgggtcggttcggggaccgtacggggacccttcgggttcccgtaacccg

SEQ ID NO: 306575 - DNA, 554 bp, Homo sapiens
  misc_feature: GZ8MTXP01D1M6M.15.16.B05.1.454.CMB.2.raw
  modified_base (353)..(353): a, c, t, g, unknown or other
  misc_feature (353)..(353): n is a, c, g, or t
  modified_base (481)..(481): a, c, t, g, unknown or other
  misc_feature (481)..(481): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgcaggctccgaggggaaggggctggagtgggtggccaccataacaaaaagntaggaagtgaacacaacctatagtagaactctgtgatggggccattcaccgtctccagagacgacgaccaagaactcactacatctgacaaatgaaacaacctgagacgccgaaggcacgggctggtntaattacttgtgttgagagagttgttacgtggcggttggggccgaggggttaccccttgggttcctaaccccg

SEQ ID NO: 306576 - DNA, 679 bp, Homo sapiens
  misc_feature: GZ8MTXP01CQCI6.15.16.B05.1.454.CMB.2.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccggggggtcctgagactctcctgtgaagcctctggattcaccttgagcacttatggatgactgggtccncaggctccgagggagggcnggagtgggtgccacataacaaaaagntaggaacgtgaacacaacctagtgtagaactctgtagtagtcgggaccgtaattccgaacccgttcgacccgaaagaacggaccgaaccggtaaccaaacggtaacctcaacctaacacttacctaggaaccaaaagttacggaaaacctaaccgtaggaaacgacgacccgggtaaacgggaccgaacgggtccgttcggtaggttaatttaaccggttggttaggttacggtaaagtaaggttacgtttgggttaccgtgggtaccggggtttcgggggaccccgtacggggggttaaccccctttgggttaacccccgttaacccggg

SEQ ID NO: 306577 - DNA, 569 bp, Homo sapiens
  misc_feature: GZ8MTXP01CBZ0L.15.16.B05.1.454.CMB.2.raw
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgagcctctggattcaccttgagcacttattggatgacttgggtccnccaggctaccgagggggaaggggctgggagtgggtgccacataacaaaaagntaggaagtgaacacaacctatagtagaactctgtgagtcggggccgtattccaccgtctaccagacgacgacgaccaaagaacctcaactacatctacgacaaatgaaaccaaccgtgaagacgacggagacacggtctgtgtaattacngtgngaacgtgttagttgttcgtggtcggttcggggccaggggttacccctgggttcctaacccg

SEQ ID NO: 306578 - DNA, 569 bp, Homo sapiens
  misc_feature: GZ8MTXP01EKXK9.15.16.B05.1.454.CMB.2.raw
  modified_base (356)..(356): a, c, t, g, unknown or other
  misc_feature (356)..(356): n is a, c, g, or t
  modified_base (499)..(499): a, c, t, g, unknown or other
  misc_feature (499)..(499): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctggagtgggtggccaccataacaaaaagntaggaagtgacacaaacctatagtgaactctgtgatgggccattcaccgtctccagagacgacgaccaaagactcaactacatctagacaaaatcgaaacaaccgtgaagacgccgaaggactacgggctggtgtaattacgnggtgttgagagacgttgttaccgtggtcggttgggggcccagggggaaccccttgggttcctaaccccgg

SEQ ID NO: 306579 - DNA, 564 bp, Homo sapiens
  misc_feature: GZ8MTXP01EWZIQ.15.16.B05.1.454.CMB.2.raw
  modified_base (553)..(564): a, c, t, g, unknown or other
  misc_feature (553)..(564): n is a, c, g, or t
tcagtctacgtagccacgaccggtgctcgatttagagctcacgtattgggtccctgagactctcctgtgaagcctctggattcaccttgagcacttattggatgacttgggtccgccaggctccagggaagggctggagtgggtggccaccatacaaaaagatggaagtgacacaacctatgtgaactctgtgatgggccgattcaccgtctccagagacgacgccaagaactcactacatctgcaaatgaaacaacctgagagccgaggacacggctgtgtattactgtgtgagagatgttctgcgttgggggccaggggaaccctggtcaccgtctcctcacgccctcaccgaacgggccccaatccgggtcccttccccccgtgggcccgtaccccctggccctcccgaagggacgccacccgtccgaagacgccaacgacggcccggccccgtggggcctcggcccgtgggtaccgaaagggtaccttacccgttcccgacgtaccggtagaccgtggacggcgggctcgggcaacggggcagattagnnnnnnnnnnnn

SEQ ID NO: 306580 - DNA, 566 bp, Homo sapiens
  misc_feature: GZ8MTXP01B6XGU.15.16.B05.1.454.CMB.2.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggctccgagggggaaggggctgggagtgggtggccaccatacaaaaagntggaagtgacacgaaccctatgtgaactctggtgagtggggccgattccacccgtctccagagacgacgaccaagaactcactacatctgacaaatgaaccaaccgtgagacgccggaaggaccgcggctggtgtaattacgttggtgttgagagagttggttctggtcgggttgggggcccagggggttacccctggggttcctcccgg

SEQ ID NO: 306581 - DNA, 575 bp, Homo sapiens
  misc_feature: GZ8MTXP01EAZW9.15.16.B05.1.454.CMB.2.raw
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtcctgagctctcctgtgagcctcnggattcaccttgagcacttattggatgacttgggtccncaggctccgaggggaggggctgggagtgggtgccaccataacaaaagntaggaagtgaacacaacctatgtanaactctgngatggggccattccaccgtctaccagacgacgacgacccaaagaactcaactacatctgacaaatcgaaacaaccgtgagacgacgaaggccgtacggctggtgtaattacgngtagttgaagngagttgttacgtgggtccgggtttgggggacccgtacggggttaacccttcgggttccgtaaccccg

SEQ ID NO: 306582 - DNA, 574 bp, Homo sapiens
  misc_feature: GZ8MTXP01BC3SW.15.16.B05.1.454.CMB.2.raw
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtcctgagactctcctgtgaagcctctggattcaccttgagcacttattggatgacttgggtccgcaggctccgagggggaaggggctggagtgggtggccacataacaaaagntggaactgacacgaacctatgtagaactctgtgagtgggccattcaccgtctccagacgacgacgacccaaagaactcaactacagtctagacaaatcgaaacaaccgtaggaagacgcccggaaggaccacgggctgtgtaattacttggtgttgaagtcgagttggttcgtggtcgggttcggggcccgaaggggttacccctgggttccctaacccgg

SEQ ID NO: 306583 - DNA, 559 bp, Homo sapiens
  misc_feature: GZ8MTXP01D4FPM.15.16.B05.1.454.CMB.2.raw
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (496)..(496): a, c, t, g, unknown or other
  misc_feature (496)..(496): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagactctcctgtgaagcctctggattcaccttgagcacttattggatgacttgggtccncaggctccgaggggaaggggctggagtgggtgccacataacaaaagntggaagtgacacaaacctatagtagaactctgtgagtcggggccgattccaccgtctccagagacgacgaccaaagaactcaactacatctagacaaaatgaaacaacctgaagagccgaaggaccacgggctgtgtaattacgngtgttgagagttagttgttcgtggtcggttcggggaccacggggaccctgggttcctaacccg

SEQ ID NO: 306584 - DNA, 540 bp, Homo sapiens
  misc_feature: GZ8MTXP01AVYLR.15.16.B05.1.454.CMB.2.raw
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (483)..(483): a, c, t, g, unknown or other
  misc_feature (483)..(483): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
  modified_base (536)..(536): a, c, t, g, unknown or other
  misc_feature (536)..(536): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggcccgggggggtccctgagactctcctgtgaagcctctggattcaccttgagcacttattggatgacttgggtccnccaggctccgaggggaggggctgggagtgggtgccaccataacaaaaagntggaagtgacacaacctatgtgaactctgtgatggggccattccaccgtctccagacgacgacgaccaaagaactcactacatctagacaaatgaaacaaccgtgagagccgaaggacacggctgtntaatacttgtgngagagngttgttcnggcgttggggccagggaccctggttcncccg

SEQ ID NO: 306585 - DNA, 603 bp, Homo sapiens
  misc_feature: GZ8MTXP01AM4CH.15.16.B05.1.454.CMB.2.raw
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagctacttattggatgacttgggtccnccgaggctccgagggggaaggggctgggagtgggtgccacataacaaaagntaggaagtgacacaacctatagtagaactctgtgagtggggcctattccaccgtctaccgagacgaccgacgacccaaagacctcaactacatctagacaaatgaaaccaacgtgaagcgaccgaaggctacgggctggtcgtaattacgttggtgttaggaagtagttagttcggtttcgtaaggggtccgggtttcgggggacccgtacgggggttaaccccttcggggttcccgttaaccccgg

SEQ ID NO: 306586 - DNA, 571 bp, Homo sapiens
  misc_feature: GZ8MTXP01DPQ6U.15.16.B05.1.454.CMB.2.raw
  modified_base (356)..(356): a, c, t, g, unknown or other
  misc_feature (356)..(356): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgcaggctccgaggggaaggggctggagtggggtggccaccataacaaaaagntaggaagtgacacaaacctatagtagaactctgtgagtggggccgattccaccgtctccagagacgacgaccaaagactcaactacatctagacaaatacgaaaccaaaccgtgaagacgaccgaaggacacgggctgtgtaattacngtgngagtagagttgttcgtgggtcggttcgggggcccacgggggttaccctgggttcctaacccgg

SEQ ID NO: 306587 - DNA, 592 bp, Homo sapiens
  misc_feature: GZ8MTXP01C51CD.15.16.B05.1.454.CMB.2.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (499)..(499): a, c, t, g, unknown or other
  misc_feature (499)..(499): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgagactctcctgtgaagcctctggattcaccttgagctacttattggatgacttgggtccncaggctccgaggggaggggctggagtgggtgccaccataacaaaaagntaggaagtgaacacaacctatagtagaactctgtgatcggggacctatccaccgtctaccagagacgacgaccaaagaactcactacatctagacaaatcgaaacaacctgacgacgccgaagggcacgggctggtagtaattacgnggtgttgaaggtgttaagttggtttccgtgggtccgggtttcgggggacccgtaacgggggttaaccccgttcggggttaaccctaaccccgg

SEQ ID NO: 306588 - DNA, 653 bp, Homo sapiens
  misc_feature: GZ8MTXP01D6815.15.16.B05.1.454.CMB.2.raw
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttccttgttgctatttagaaggtgtccagtgtgaggtgcaacgtggtggagtcgtgggggaggcctcgtccgaggccggggggtcctgacgactctcctgtgaacgcctcgtggacttcacttgagctacttagttggatgtacgttcgggtccgccgaggcctaccggaagggggaacgggggcgtaggggtaggtcggggtcggacccaaccgaaataaacgaaaaaagagtaggaaagtacggaacaactaacctagtaacgtagtaactgtagtagagtcgggaccgtattccaccgtcaccagacgacgacgacaaagactcactacntacacgaactaaacgngaaaaccaccgagaacgacgacggaaagaccgtacgggtcgtagttgttaagttcgttggtaggttagtaggtacgttagttcggttcggtggggttaccgggtcggggaaccggtaccgggttacccgttcggttaacccgtcccg

SEQ ID NO: 306589 - DNA, 590 bp, Homo sapiens
  misc_feature: GZ8MTXP01BZ4CY.15.16.B05.1.454.CMB.2.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
  modified_base (529)..(529): a, c, t, g, unknown or other
  misc_feature (529)..(529): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagctacttattggatgacttgggtccgccaggctccgaggggaagggggctgggaggtgggtgccacataacaaaagnaggaagtgacacaacctatgtanaactcgtgtgagtgggcctattccgacccgtctaccagacgaccgaacgaccaaagaacctcaacttaacatctagacaaaatacggaaaccaaaccgtgaagacgacccgaggtacacggctgtcgtaattacgttgtagttgaggngttattggttcgtggtacgggtcggggcccgaggggttaccccgtgggttcccgtaacccg

SEQ ID NO: 306590 - DNA, 573 bp, Homo sapiens
  misc_feature: GZ8MTXP01BTUDH.15.16.B05.1.454.CMB.2.raw
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
  modified_base (473)..(473): a, c, t, g, unknown or other
  misc_feature (473)..(473): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttattggatgacttgggtccgccaggctccgaggggaggggctggagtgggngccaccataacaaaagntggaacgtgacacaacctatagngaactctgtgacgtggggcctattccaccgtctcccgagacgacgaccgaccaaagacctacactacatactgacaaatgaaaccaccgtgaacgngaccgaggacacggctgtgtaattcttggtgagagtagttacgttgttaccgtgggtcgggttcggggccacggggttaaccctcggttcccgtaacccg

SEQ ID NO: 306591 - DNA, 552 bp, Homo sapiens
  misc_feature: GZ8MTXP01B1QPJ.15.16.B05.1.454.CMB.2.raw
  modified_base (350)..(350): a, c, t, g, unknown or other
  misc_feature (350)..(350): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagcctctggattcaccttgagcacttattggatgacttgggtccgccaggctccgaggggaggggctggagtgggtgccacataacaaaagntggaagtgaacacaaacctatgtgaactctgtgagtggggcccgattccaccgtctcccagacgacgacgacccaaagaacctcactacatcctgacaaatgaaacaacctgaacgagcccgaggaccacggctgtgtaattacngtgttgagngagttgttcgngtcggttggggcccagggggaccctgggttcctcccg

SEQ ID NO: 306592 - DNA, 575 bp, Homo sapiens
  misc_feature: GZ8MTXP01DZ9TN.15.16.B05.1.454.CMB.2.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgagcctctggattcaccttgagcacttattggatgacttgggtccnccaggctccgagggggaaggggctgggagtgggtggccaacataacaaaaagntaggaagtgacacaacctatagtanaactctgtgagtgggccgattccaccgtctccagacgacgacgaccaaagactcaactacatcctagacaaaatgaaacaacctgagacgccgaaggacacgggctgtgtaattacgttgtgttagagagttagttgttcgtggtcgggttcggggacccacggggttaaccccttgggttccctaaccccgg

SEQ ID NO: 306593 - DNA, 569 bp, Homo sapiens
  misc_feature: GZ8MTXP01AFOXO.15.16.B05.1.454.CMB.2.raw
  modified_base (354)..(354): a, c, t, g, unknown or other
  misc_feature (354)..(354): n is a, c, g, or t
tcagtctacgtagccacgaccggtgctcgatttagagctcacgtattgggtttgaggtctcagagaggagccttagccctggattccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctggagtgggtgccaccataacaaaagntaggaacgtgacacaacctatagtgaactctgtgatggggcctattcaccgtctccagagacgacgaccaagactcactacatctgacaaatacgaacaacccgtgagacgccggaaggaccgacggctgtgtaattacttggtgttgagagttagttgttcgtggtcggttcgggggacccgtagggggaccccttgggttcccgtaaccccgg

SEQ ID NO: 306594 - DNA, 585 bp, Homo sapiens
  misc_feature: GZ8MTXP01CMMY1.15.16.B05.1.454.CMB.2.raw
  modified_base (355)..(355): a, c, t, g, unknown or other
  misc_feature (355)..(355): n is a, c, g, or t
  modified_base (521)..(521): a, c, t, g, unknown or other
  misc_feature (521)..(521): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgagcctctggattcaccttgagcacttattggatgacttgggtccgccaggctccgaggggaaggggctgggagtggggtgccaccgataacaaaaagntaggaacgtgacacaaaccctatagtagaactctagtgagtggggcctattccacccgtctacccaggacgaccgacgaccaaagaactcactacatctgacaaatcgaaaccaaccgtgaacgacgaccggaaggaccacggcttggtgttaacttacgttgtgngaacgtagagttgttccgtggcggttcgggggcctaacggggaacccgtggttcccgtaacccg

SEQ ID NO: 306595 - DNA, 648 bp, Homo sapiens
  misc_feature: GZ8MTXP01BJNN8.15.16.B05.1.454.CMB.2.raw
  modified_base (382)..(382): a, c, t, g, unknown or other
  misc_feature (382)..(382): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccgaggccggggggtcctgagactctcctgtgaacgcctctggattcaccttgagctacttagttggatggtacgttcggggtcccgccagggcctaccggagggggaacggggtcgtgggaggtggggtcggacccaaccaataaacaaaaagntaggaagtgaacactaacctatagtagaacttcgtagtgagtcggggacctattcccacccgtctaccaggagaccgaccgacaaagaacctcactacacttacacgaacaaagtacgaaaacctaacccgtaggaacgacgaccggaacggaccgacgggcttggtacgtaatttacgttggtgttagaggtagttagttcggtttcgtgggtcgggttcggggacccgtacggggttaaccccgttggttccccgtaaccccgg

SEQ ID NO: 306596 - DNA, 555 bp, Homo sapiens
  misc_feature: GZ8MTXP01BNUT9.15.16.B05.1.454.CMB.2.raw
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagcacttattggatgacgttgggtcccgccaggctccgaggggaggggctggagtgggngccacataacaaaagntaggaagtgacacaacctatgtagaactntgtgatgggcattcaccgtntccagagacgacgaccaagaacctcactacatctagacaaatacgaacaaccgtgaagacgaccgaggacacgggctgtgtaacttagnggtgttgagtagngttggttcnggtcggttggggacccgtacggggaccctgggttccgtcccg

SEQ ID NO: 306597 - DNA, 556 bp, Homo sapiens
  misc_feature: GZ8MTXP01BTQE6.15.16.B05.1.454.CMB.2.raw
  modified_base (473)..(473): a, c, t, g, unknown or other
  misc_feature (473)..(473): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccaggccgggggggtccctgagactctcctgtgaagcctctggattcaacttgagcacttattggatgacttgggtccgccaggctccgaggggaaggggctgggagtgggtggccaccgataacaaaaagatggaaagtgaacacgaaacctatagtgaactctgtgagtggggccgtattccaccgtctccagagacgacgaccaaagaactcactacatctgacaaatgaaaccacctgacgngacgaggcacggctgtgtaattcngtgngagngttattggttcnggtcggttggggccaggggaccctgggttccgtaacccg

SEQ ID NO: 306598 - DNA, 591 bp, Homo sapiens
  misc_feature: GZ8MTXP01BQ7AC.15.16.B05.1.454.CMB.2.raw
  modified_base (348)..(348): a, c, t, g, unknown or other
  misc_feature (348)..(348): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccgaggccgggggggtccctgagactctcctgtgaagcctctggattcaccttgagcacttattgatgacttggtccgcaggctccgaggggaggggctggagtgggtgccacatacaaaagntaggaagtgaacacaaacctatacgtagaactctgtgatggggccgattccaccgtctccagacgacgaacgaccaaagaactcaactacagtactgacaaatagaaaccaacctgaagacggacgaggacacgggtctggtgttaattacgnggttagngtaagaggttagtttcggttcgtgggtcgggttcggggggcccgaacgggggttaaccccttggggaaccccgttaaccccgg

SEQ ID NO: 306599 - DNA, 566 bp, Homo sapiens
  misc_feature: GZ8MTXP01CRMR4.15.16.B05.1.454.CMB.2.raw
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaggtgtccagtgtgaggtgcaactggtggagtcgtgggggagcctcgtccgaggcccggggggtcctgagactctcctgtgaagcctctggattcaccttgagctacttattggatgacttgggtccnccgaggctccggaggggaaggggctggagtgggtgaccacataacaaaaaggtaggaagtgacactaacctatgtanaactctgtgatcggggcctattccaccgtctaccgagacgacgaccgaccaaagaacctcactacagtactgactaaactgaaaccaaccgtagacgacgccgaaggacccaggtctagtgtaacttagngtgngagngttagttgttcgtggcggttgggccgacgggaccctggccgtcccg

SEQ ID NO: 306600 - DNA, 563 bp, Homo sapiens
  misc_feature: GZ8MTXP01B4Y32.15.16.B05.1.454.CMB.2.raw
  modified_base (349)..(349): a, c, t, g, unknown or other
  misc_feature (349)..(349): n is a, c, g, or t
  modified_base (507)..(507): a, c, t, g, unknown or other
  misc_feature (507)..(507): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccaggccggggggtccctgagactctcctgtgagcctctggatcaccttgagcacttatggatgacttgggtccacgaggctccgaggggaggggctggagtgggtggccacataacaaaaagntaggaagtgacacaacctatgtagaactctgtgagtcggggacctattccaccgtctaccagagacgacgaccaagaactcactacatctagacaaatagaaacaacctagacgacggccgaaggaccgtacggctgtgtaattacttggtgttgagngttagttgttcgtggtcgggttcgggccgacggggttacccgtcggttccgtcccg

SEQ ID NO: 306601 - DNA, 608 bp, Homo sapiens
  misc_feature: GZ8MTXP01DPNT3.15.16.B05.1.454.CMB.2.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtccctgagactctcctgtgaagcctctggattcaccttgagctacttattggatgacgttgggtccnccgaggctccgagggggaaggggcgtggaggtgggtcgaccacaataaacgaaaaagngtaggaagtgaacacaacctatagtagaactctgtgagtcggggacctattccaccgtctaccagacgacgacgaccaaagactacactacatctagacaaatacgaaaccaaccgtagaaggacgaccggaaggaccgacggtcgtggtagttaacttaacgttggttagttaggtaagagttagttgttcgtggtacgggttcggggacgtacgggttacccgtcggttccgtaaccccg

SEQ ID NO: 306602 - DNA, 618 bp, Homo sapiens
  misc_feature: GZ8MTXP01DC469.15.16.B05.1.454.CMB.2.raw
  modified_base (556)..(556): a, c, t, g, unknown or other
  misc_feature (556)..(556): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttatggatgtacgttcgggtccgccaggctccgagggggaaggggctgggaggtggggtcgggaccaccaataaacgaaaaagagtagggaaacgtgaacacgaacctagtagtagaactcgtgtagagtcgggccgtatccgacccgtcctaccgaagacgaccgaacgaccaaacgaactcaactaacatactagacaaaatacgaaaccaaccgtgaacgacggcgaacggtacgacggtcgtgtgtaattacgttggtgttaggtagngttagttggttcgtgggacggttcggggaccgtacggggttaacccgtggttcctaacccgg

SEQ ID NO: 306603 - DNA, 600 bp, Homo sapiens
  misc_feature: GZ8MTXP01CV8GB.15.16.B05.1.454.CMB.2.raw
  modified_base (361)..(361): a, c, t, g, unknown or other
  misc_feature (361)..(361): n is a, c, g, or t
  modified_base (463)..(463): a, c, t, g, unknown or other
  misc_feature (463)..(463): n is a, c, g, or t
  modified_base (555)..(555): a, c, t, g, unknown or other
  misc_feature (555)..(555): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggattcaccttgagcacttattggatgacgttggtccgcgaggctccgaggggaaggggctaggaggtgggtggccaaccaataaacaaaaaagngtaggaaacgtgaacacaaacctatgtagaacttcgtggtagagtcggggccgtattccgaccgttcaccgagacgacgacgaacccaaagaactcaactanacttacacgaacgaaatacgaaaccaaccgagagacgcgaacgtacgacggtctgtgttaatagttggtgttgagtaagttcgttggttcgngggtcgggttcgggaccggtaccggaccgttcgggccttaacccg

SEQ ID NO: 306604 - DNA, 607 bp, Homo sapiens
  misc_feature: GZ8MTXP01C89XV.15.16.B05.1.454.CMB.2.raw
  modified_base (371)..(371): a, c, t, g, unknown or other
  misc_feature (371)..(371): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagctacttattggatgacgttcgggtccgcgaggctaccgagggggaacggggctgggaggtggggtcggccaaccgaataaacgaaaaaagntaggaaagtgaacactaaacctatacgtagaactcgtgtagagtcgggaccgtatccaccgtctaccgagacgaccgacgacaaagacctcaactacatactagacaaatacgaaaccaaccgtagacgacgccgaaaggaccaggtctgtgtaacttagttgtggagtacggtgagttgttacgtggtacgggttcggggaccggtacgggacccgttcgggcccgtaaccccgg

SEQ ID NO: 306605 - DNA, 643 bp, Homo sapiens
  misc_feature: GZ8MTXP01C39NB.15.16.B05.1.454.CMB.2.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (583)..(583): a, c, t, g, unknown or other
  misc_feature (583)..(583): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctattttagaaggtgtccagtgtgaggtgcaactggtggagtcgtgggggagcctcgtccgaggccggggggtccctgagactctcctgtgaagcctctggattcaccttgagcacttagttggatgtacgttcgggtccnccgaggctccgagggggaaggggctgggaggtgggtcggcccaaccataacgaaaaagntaggaaacgtgaacacgaaacctatacgtagaactctgtgagtcggggacctattccaccgtctacccgagacgacgaacgacaaacgactcaactacatctagaactaaaagtcggaaaaccaaccgtagaacggacggaccggaaaggaccaccggggtctaggttacggttaattaacgttggttaggaggtaaggtagttacgttggttacggngggttcgggttaacgggggacctacgggggttaaccccttggggttaacccttaacccgg

SEQ ID NO: 306606 - DNA, 702 bp, Homo sapiens
  misc_feature: GZ8MTXP01AYE9O.15.16.B05.1.454.CMB.2.raw
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcggtccgaggccgggggggtccctgagactctcctgtgagcctctggattcaccttgagcacttattggatgacttgggtccnccaggctccgagggggagggctgggagtggggtgccacaataacaaaaagngtaggaaacgtgacacaacctatagtagaactcgtgaggtagtcggggtccgtaattccaaccccggttcctaccccgaagggaacgggaaccggaacccggaacccctaaaaacggaaacctaccctaaaccttaaacccagttaccttaacggaacctaaaatacggaaaacctaaacccgttagggaacggacggaccccggaaagggtacccgaaccgggggtcttgggttagttaacgttttaacgttggtggttaggaaggtacgagttggtttccgtgggtccgggtttaacgggggcccgaaacggggttaccccttggggttaacccctaaccccgg

SEQ ID NO: 306607 - DNA, 545 bp, Homo sapiens
  misc_feature: GZ8MTXP01DNZCS.15.16.B05.1.454.CMB.2.raw
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgttgctatttagaaggtgtcagtgtgaggtgcaactggtggagtctgggggagcctcgtccaggccgggggggtcctgagactctcctgtgaagcctctggatcaccttgagcacttatggatgacttgggtccncaggctccgaggggagggctggagtgggtggccacataacaaaagntaggaaatggacacaaacctatgtagaactcgtgngatcggggctattccgaccgtctaccagagaccgacgaccctaaagaactcaacttacattcagactaaaatcgaaaccaaccgagagacgccgaaggacctagctggtntaatttacgngtgngagngttgttgttcgnggtcggtcggcgtacggacctcgccgtcg

SEQ ID NO: 306608 - DNA, 598 bp, Homo sapiens
  misc_feature: GZ8MTXP01EDKLN.15.16.B05.1.454.CMB.2.raw
  modified_base (355)..(355): a, c, t, g, unknown or other
  misc_feature (355)..(355): n is a, c, g, or t
  modified_base (496)..(496): a, c, t, g, unknown or other
  misc_feature (496)..(496): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtcctgagactctcctgtgaagcctctggattcaccttgagctacttattggatgacgttgggtccgccaggctccgaggggaggggctggagtgggtgccaccataacaaaagntaggaatgacaacaacctatagtagaactctggtgagtcggggccgtattccacccgtctaccgaaggacgaaccgacgaccaaagaactcaactacatctgacaaatgaaaccaaccgtgaagcgccgaaggacacgggnttcggtgtaattacgttggtgttagagtagttagttggttccgtgggtccgggttcgggggacccgtaacgggggttaccccttcgggttcccgtaaccccg

SEQ ID NO: 306609 - DNA, 572 bp, Homo sapiens
  misc_feature: GZ8MTXP01DD9F9.15.16.B05.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccgggggggtcctgagactctcctgtgaagcctctggattcaccttgagcacttatggatgacttgggtccncaggctccgagggaggggctggagtggtggccacatacaaaaagntaggaacgtgacacaacctagtgtagaactcngtgagtggggcctattccaccgtctacccagacgacgacgactaagaactcaactacaatcctgacaaatacgaaacaaccgtgaacgagaccgaaggaccacgggctgtgtaattacttggtgngtaggngttagttgttactggtacggttcggggccgagggggttaaccctgggttccgtaacccg

SEQ ID NO: 306610 - DNA, 564 bp, Homo sapiens
  misc_feature: GZ8MTXP01AGLIM.15.16.B05.1.454.CMB.2.raw
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgcaggctccgaggggaggggctggagtgggtcgccaccatacaaaaagntaggaacgtgacacaacctatgngaactctgtgatcggggcattcaccgtctccagacgacgacgacccaagaactccaacttacatctgacaaatcgaaacaacctgagacgaccgagacacgggctggtgtaattcgttgtgttgagagttagttgttaccgtggtcggttcgggggccacggggttaacccctggttccgtaaccccg

SEQ ID NO: 306611 - DNA, 622 bp, Homo sapiens
  misc_feature: GZ8MTXP01EGTZD.15.16.B05.1.454.CMB.2.raw
  modified_base (611)..(613): a, c, t, g, unknown or other
  misc_feature (611)..(613): n is a, c, g, or t
  modified_base (615)..(622): a, c, t, g, unknown or other
  misc_feature (615)..(622): n is a, c, g, or t
tcagtctacgtagccacgaccggtgctcgatttagagctcacgtattgggtccctgagactctcctgtgaagcctctggattcaccttgagcacttattggatgacttgggtccgccaggctccgagggaaggggctggagtgggtggccaccataacaaaaagatggaagtgacacaacctatgtgaactctgtgatgggccgattccaccgtctccagagacgacgccaagaactcactacatctgacaaatgaaacacctgagagccgaggacacggctgtgtattactgtgtgaagagattggtttctggtcggtttcggggggcctaacgggggtaacccctgggtccaccgtctccctcaccgcccctaccaccgaacggggcccctaaacgttcccgggttcccttccccccgtgggccccgtcccctggaccctacggaaacgggaccgccaacccgtccgaaggacgccgaccgacggccgggccccgtggggcctcggtccgttgggtaccggaaacgggtaccttaaccgttcccgacgttaaccggtaacgtaccgtagggacggccgggtcgtcggggacgaagggcggacagttagnnngnnnnnnnn

SEQ ID NO: 306612 - DNA, 565 bp, Homo sapiens
  misc_feature: GZ8MTXP01CX4PN.15.16.B05.1.454.CMB.2.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
  modified_base (482)..(482): a, c, t, g, unknown or other
  misc_feature (482)..(482): n is a, c, g, or t
  modified_base (519)..(519): a, c, t, g, unknown or other
  misc_feature (519)..(519): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgaagcctctggattcaccttgagctacttattggatgactgggtccncaggctccgaggggaaggggctggaggtgggtggccaccgataacaaaaagntaggaagtgaacacgaaacctatgtanaactctgtgatggggcctatcaccgtctccagagacgacgacaaacgactcactacatctagacaaatgaaaccaacctgagacgaccgagacgaccggntgtgtaattacttggtgttgagagttacgttgttcgnggtcggttcggggcccgtaggggttaacccctggggccctaacccg

SEQ ID NO: 306613 - DNA, 605 bp, Homo sapiens
  misc_feature: GZ8MTXP01D2BBT.15.16.B05.1.454.CMB.2.raw
  modified_base (265)..(265): a, c, t, g, unknown or other
  misc_feature (265)..(265): n is a, c, g, or t
  modified_base (362)..(362): a, c, t, g, unknown or other
  misc_feature (362)..(362): n is a, c, g, or t
  modified_base (526)..(526): a, c, t, g, unknown or other
  misc_feature (526)..(526): n is a, c, g, or t
  modified_base (541)..(541): a, c, t, g, unknown or other
  misc_feature (541)..(541): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtgggtggagtcgtgggggaggcctcgtccgaggccggggggtcctgagctctctgtgagcctnggattcaccttgagctattattggatgacgttcggccgcgaggctccgagggggaagggcgtgggaggtgggtcggaccaccaataaacgaaaaagngtaggaagtagacaacaaacctatagtacgaactctagtgtaagtcggggacctattccgacccgttctaccaaggacgaacgaccgaccaaagactacaactacattactagactaaaatcgaaaccaaccgtagaacggacgaccggaaaggccgtacgggnttgtagtaattacgnggtagttgagtagttgttgttcgtggtcggttcggggccacggggttacctcgggttcctcccg

SEQ ID NO: 306614 - DNA, 594 bp, Homo sapiens
  misc_feature: GZ8MTXP01ERVG9.15.16.B05.1.454.CMB.2.raw
  modified_base (358)..(358): a, c, t, g, unknown or other
  misc_feature (358)..(358): n is a, c, g, or t
  modified_base (525)..(525): a, c, t, g, unknown or other
  misc_feature (525)..(525): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccaggccggggggtcctgagactctcctgtgagcctctggattcaccttgagctacttattggatgacttgggtccgcaggctccgaggggaaggggctgggagtgggtcggccaaccaataacaaaaagngtaggaacgtgaacacaaacctagtagtagaactctgtgagtcggggccattccaccgtctaccagacgacgacgaccaaagaacctcaactacatctagacaaatcgaaaccaaccgtgaacgacgaccggaaggtacacgggtctggtgtaatttacgttggtgngaagtgagttggttaccgtgggtccgggttcgggggaccgaggggttaaccctcgggttcctaacccgg

SEQ ID NO: 306615 - DNA, 611 bp, Homo sapiens
  misc_feature: GZ8MTXP01CF4PX.15.16.B05.1.454.CMB.2.raw
  modified_base (372)..(372): a, c, t, g, unknown or other
  misc_feature (372)..(372): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagcctcgtccgaggccggggggtcctgagactctcctgtgagcctctggattcaccttgagcacttattggatgacgttgggtccgccgaggccgtccgagggggaaggggcgtgggaggtggggtcggcccaaccgaataaacgaaaaaagngtaggaaagtgacaacaaacctatagtagaactcgtgtgagtcgggcctattccaccgtctccgagacgaccgacgaccaaagactcaactacatctagacaaatacgaaaccaaccgtgaacgacgaccgaaggacctacgggtcttgtgttaacttagttggtagttagaagtgttagttggttcgtgggtcggttcgggggcccgaacggggttaccctggggttccctaacccgg

SEQ ID NO: 306616 - DNA, 603 bp, Homo sapiens
  misc_feature: GZ8MTXP01A5ADT.15.16.B05.1.454.CMB.2.raw
  modified_base (270)..(270): a, c, t, g, unknown or other
  misc_feature (270)..(270): n is a, c, g, or t
  modified_base (355)..(355): a, c, t, g, unknown or other
  misc_feature (355)..(355): n is a, c, g, or t
  modified_base (527)..(527): a, c, t, g, unknown or other
  misc_feature (527)..(527): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctccgtgtgaagcctcgtggnttcaccttgagctacttagtggatgacgttgggtccgcaggcctccgaggggaagggctggagtgggcgccacataacgaaaagntaggaaacgtgaacacaacctagtacgtagaacctgtaggtgagtcggggacctattcccgaccgtctacccgagacgaccgaccgaccgaaactactcaactacatactagaacaaagtacgaaaccaacgtagagacgaccgaacggactacggctgtacgtaattacgngtagttcgaagagttagtttcggttcgtcgggtcgggttcggggcaacgggggttacccttgggcccgttaacccg

SEQ ID NO: 306617 - DNA, 620 bp, Homo sapiens
  misc_feature: GZ8MTXP01BFCT0.15.16.B05.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (522)..(522): a, c, t, g, unknown or other
  misc_feature (522)..(522): n is a, c, g, or t
  modified_base (536)..(536): a, c, t, g, unknown or other
  misc_feature (536)..(536): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggtttcctgttgctatttagaggtgtccagtgtgaggtgcaactggtggagtcgtgggggagcctcgtccgaggccggggggtcctgagctctcctgtgagcctcgnggattcaccttgagctaacttattggatgtacttcggggtccnccgaggctaccgaggggagggctgggagtgggtcgcccaaccgataacaaaaagctaggaacgtcgacacaacctntagtanaacctgtgtgtagtcggggcctattccaccgtcgtacccgagacgaaccgacgaacccaaacgtactacgactacattcacgtacaaaagttcgaaaccaaccgtgaacgacgtaccggagacccgacggtctgggtnttaacgtcgttggngttagaagtaagttgttcgttcgtaacgggtcgggttcggggacccggtacgggttaaccccgtcgggttaaccctaaccccgg

SEQ ID NO: 306618 - DNA, 572 bp, Homo sapiens
  misc_feature: GZ8MTXP01AK0O9.15.16.B05.1.454.CMB.2.raw
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (350)..(350): a, c, t, g, unknown or other
  misc_feature (350)..(350): n is a, c, g, or t
  modified_base (430)..(430): a, c, t, g, unknown or other
  misc_feature (430)..(430): n is a, c, g, or t
  modified_base (510)..(510): a, c, t, g, unknown or other
  misc_feature (510)..(510): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctcgtccgaggccggggggtcctgagactctcctgtgagcctctggattcaccttgagctacttattggatgacttgggtccncaggctccgagggagnggctggagtgggtggccacataacaaaagntggaatgacacaactaatgtgaactctgtgagtggggcctattccaccgtctccgagacgacgaccgcaagactcactanatcctaggactaaagtcgaaaccaccgtgaacgacgaccggaggacacgggtctggtaacttattacgtgttggtgaagnggttattcggttctgggtcgggttcgggggacccgacggggtaaccccgttgggtaaccccg

SEQ ID NO: 306619 - DNA, 587 bp, Homo sapiens
  misc_feature: GZ8MTXP01DGQ7O.15.16.B05.1.454.CMB.2.raw
  modified_base (304)..(304): a, c, t, g, unknown or other
  misc_feature (304)..(304): n is a, c, g, or t
  modified_base (507)..(507): a, c, t, g, unknown or other
  misc_feature (507)..(507): n is a, c, g, or t
  modified_base (527)..(527): a, c, t, g, unknown or other
  misc_feature (527)..(527): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccncaggctccgaggggaagggggctgggaggtgggtggacccaccaataacaaaaagagtaggaacgtgaacacaaccctatacgtagaactctgtgagtcggggcctagttccacccgtctacccagacgaccgacgaccaaagaacctcaactacattcagacaaatcgaaaccaactgacgagccgaaggacacggctggtntaattcgttggtgttgaagngagttgttcgtgggtacggttcgggggccacggggttaccccgtggttcccgtaacccgg

SEQ ID NO: 306620 - DNA, 557 bp, Homo sapiens
  misc_feature: GZ8MTXP01ACHJW.15.16.B05.1.454.CMB.2.raw
  modified_base (310)..(310): a, c, t, g, unknown or other
  misc_feature (310)..(310): n is a, c, g, or t
  modified_base (360)..(360): a, c, t, g, unknown or other
  misc_feature (360)..(360): n is a, c, g, or t
  modified_base (504)..(504): a, c, t, g, unknown or other
  misc_feature (504)..(504): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccgaggccgggggggtccctgagactctcctgtgaagcctctggattcaccttgagctaacttattggatggacttggggtcccnccgaggctccgaggggaaggggctgggagtgggtgccacataacaaaagntaggaagtgacacaacctatgtagaactctgtgagtcgggcgattcaccgtctaccagagacgacgaccaagaactcactacatcctagacaaatcgaacaactgagacgcgaggactaggctgtgtaatacgttgtgttgagngttagttgttctggcgggttggggaccgtacggggacccttgggcctaacccg

SEQ ID NO: 306621 - DNA, 613 bp, Homo sapiens
  misc_feature: GZ8MTXP01CIBNE.15.16.B05.1.454.CMB.2.raw
  modified_base (365)..(365): a, c, t, g, unknown or other
  misc_feature (365)..(365): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (570)..(570): a, c, t, g, unknown or other
  misc_feature (570)..(570): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctcgtccgaggccggggggtcctgagactctcctgtgaagcctctggattcaccttgagctacttagttggatggacgttcgggtaccgccaggcctaccgagggggacggggctgggagtgggtcgaccacataacaaaaagntaggaacgtcgacacaacctataagtagaactcgtgtagagtcggggcctaattcccaacccgttctacccgaaggacgaacgaccgaccaaacgaactccaactacagttcacgaacaaaatacgaaaccaaccgaggacgaaaccgccgaagggtccacggtctgtgtaattacgttgtagngaaacgngttagttccgtttncgggtcgggtcgggccgtacggggaccccttgggcctaacccg

SEQ ID NO: 306622 - DNA, 574 bp, Homo sapiens
  misc_feature: GZ8MTXP01BUEJZ.15.16.B05.1.454.CMB.2.raw
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagcctcgtccgaggccggggggtcctgagctctcctgtgagcctctggattcaccttgagcacttattggatgacttgggtccncaggctccgaggggagggctggagtgggtgccaacataacaaaaagtaggaatgaacacgaacctatgtanaactntgtgagtgggccattccaccgtctcagagaccgacgaccaaagaactcaacacatactgaacaaatcgaaacaccgtagaacgacgaccgaaggaccacggctgtgttaattaacttggtgagtaacgagttagttcgttcgtggtcgggttcggggaccgtacggggttaacccctcgggttcccgtaaccccg

SEQ ID NO: 306623 - DNA, 573 bp, Homo sapiens
  misc_feature: GZ8MTXP01CASFR.15.16.B05.1.454.CMB.2.raw
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccgaggccggggggtccctgagactctcctgtgaagcctctggattcaccttgagcacttattggatgacttgggtccgccaggctccgaggggaggggctggagtgggtgccacataacaaaagntaggaacgtgacacaacctatgtanaactctgtgagtcggggccgattccgaccgttctaccgaggacgaccgacgacccaagaactcactacatctagacaaatgaaaccacctgaagcgaccgacggacaccggtntgtagtaatacgttgtggttgaggngagttgttcgtggacgggtttcggggccgacgggggttaacccttgggccctaacccgg

SEQ ID NO: 306624 - DNA, 639 bp, Homo sapiens
  misc_feature: GZ8MTXP01DHHDY.15.16.B05.1.454.CMB.2.raw
  modified_base (379)..(379): a, c, t, g, unknown or other
  misc_feature (379)..(379): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggattcaccttgagctacttatggatgtacgttcgggtccgccgaggcctccggaagggggaagggggctaggggaggtcgggggtggacccaaccgaataaacgaaaaaagntaggaaagtagaacaacgaaacctatagttagaactcgtgtagtagtcgggaccgtattccgacccgttctacccgaggacgaaccgacgaccaaagaacctcaactacaatctagaacaaaagtacgaaaccaaccgtagaacgacggaccggtaaggacacgggcttgtacgttaattaacgttggtattggaaacgtgttagttgttcccgtgggcggttaacggggccgtaacgggaccccgttggccctaacccg

SEQ ID NO: 306625 - DNA, 614 bp, Homo sapiens
  misc_feature: GZ8MTXP01CNEIY.15.16.B05.1.454.CMB.2.raw
  modified_base (367)..(367): a, c, t, g, unknown or other
  misc_feature (367)..(367): n is a, c, g, or t
  modified_base (556)..(556): a, c, t, g, unknown or other
  misc_feature (556)..(556): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtccctgagactctcctgtgaagcctctggattcaccttgagctacttattggatgacttgggtccgccaggctccgaggggaaggggctgggaggtgggtcggaccaaccgaataacgaaaaaagntagggaaacgtgaacaacgaaacctagtagtagaactctgtgagtcggggacctattccgaccgtctaccgaagacgaccgacgaccaaacgaactcactacatctagactaaatacgaaacaaccgtagaacgacgacccggaaggactacggtacgtgtacgtaattaacgttggttgttaggaagngttagttgttcgtggtcgggttcggggccgtacggggacccttgggttccgtaacccg

SEQ ID NO: 306626 - DNA, 600 bp, Homo sapiens
  misc_feature: GZ8MTXP01BJJBZ.15.16.B05.1.454.CMB.2.raw
  modified_base (296)..(296): a, c, t, g, unknown or other
  misc_feature (296)..(296): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(600): a, c, t, g, unknown or other
  misc_feature (590)..(600): n is a, c, g, or t
tcagtctacgtagccacgaccggtgctcgatttagagctcacgtattgggtccctgagactctcctgtgaagcctctggattcaccttgagcacttattggatgacttgggtccgccaggctccgagggaaggggctggagtgggtggccaccataacaaaaaagatggaagtgacacaacctatgtgaactctgtgatgggccgattccaccgtctccagagacgacgaccaaagaactcactacatctgacaaatgaaacaacctgagagccgaggacacggctgtgtattacnggtgtgagagattgttctggtcggttgggggccacgggggaacccttgggtccaccggtctcctcacgccctacaccgaacggggcccaagttccgtccttccccgnggccnccctgcctcgaggcncaccgtcgagacgcacgacgggcccggcccgtggggcctcgcccgttcgggtaccggtaaacgggtaccttacccgttacccggtacctaacggtacggtaacgtcgggacggtcccgggggcttacgggggaccgaaacggggcccggaacgtagttagngngngnnnnnnnnnnn

SEQ ID NO: 306627 - DNA, 586 bp, Homo sapiens
  misc_feature: GZ8MTXP01B2G9D.15.16.B05.1.454.CMB.2.raw
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtcctgagactctcctgtgaagcctctggattcaccttgagcacttattggatgacttgggtccncaggctccgagggggagggctgggagtgggtgaccacataacaaaaagntggaaagtgaacacgaacctatgtagaactctgtgagtgggccgattccaccgtctccgagagaccgacgacctaaagaactcaactacatcgtagacaaaatcgaaacaaccgtgaagacggacccgaagggtaccacgggctggtgtaacttacgttgtagttgaaggtagttagttcgttcgtggcggttcgggggccaacggggacccctggggttaaccctaacccgg

SEQ ID NO: 306628 - DNA, 603 bp, Homo sapiens
  misc_feature: GZ8MTXP01EQ0C4.15.16.B05.1.454.CMB.2.raw
  modified_base (371)..(371): a, c, t, g, unknown or other
  misc_feature (371)..(371): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagctctcctgtgaagcctctggattcaccttgagctacttattggatgacgttgggtcccgccgaggcctccggagggggaacggggcgtgggaggtggggtcgacccaccaataacgaaaaaagngtaggaaagtgaacaacaaacctatgtagaactcgtgtgagtcgggcattccaccgtcaccagacgacgacgaccaaagacctcaactacatctgactaaatcgaaaccaaccgtgaagacgaccggaaggacctacggcttgtgtaactttgttggtgttcgagtagttacgttggttcgtggtcgggttcggggaccgtacggggttaaccctgggttccctaaccccgg

SEQ ID NO: 306629 - DNA, 636 bp, Homo sapiens
  misc_feature: GZ8MTXP01DLW05.15.16.B05.1.454.CMB.2.raw
  modified_base (357)..(357): a, c, t, g, unknown or other
  misc_feature (357)..(357): n is a, c, g, or t
  modified_base (416)..(416): a, c, t, g, unknown or other
  misc_feature (416)..(416): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtctggaggggaggcctcgtccgagggcccgggggggtccctgagactctcctgtgacgcctctggattcaccttgagcacttattggatgacttgggccgcaggctcgaggggagggctggagtgggtgccacaataacaaaagngtaggaagtgacaacaacctaatgtgaactcgtgtgagtcggggcctattccaccgtcnccgagacgacgacgaccaaagaactcaactacattcctaggaactaaaagtacgaaacctaacctggaacgaacggacccgggaagggaaccctaacggggtcttggttaacgttaagttttacgtggttaggttaggaagttaagttgtttcggttcgtgggttccggggtttacgggggacccgttaacgggggtaaccccgttcggggttaaccccg

SEQ ID NO: 306630 - DNA, 599 bp, Homo sapiens
  misc_feature: GZ8MTXP01AQQQZ.15.16.B05.1.454.CMB.2.raw
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (468)..(468): a, c, t, g, unknown or other
  misc_feature (468)..(468): n is a, c, g, or t
tcagtctacgtagccacgaccggtgctcgatttagagctcacgtattgggtttgaggtctcagagaggagccttagccatggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggcccggggggtccctgagactctcctgtgaagcctntggattcaccttgagcacttatggatgacttgggtccncgaggctcgaggggagggctggagtgggtgccacataacaaaagntacggaagtgacacaacctaagtgtgaactcgtgtgagtcggggcctattccaccgttcaccgagagacgacgacaacgactcactacactctacggacaaatcgaaacctaaccgnggaacgacggaccgaaggtaccaacgggtcttgtaagttacttagtggttagtaggaagttagttagtttcgttcggtcggtcggggtttacggggacccggttaacggggtaacccgttgggtaaccccg

SEQ ID NO: 306631 - DNA, 634 bp, Homo sapiens
  misc_feature: GZ8MTXP01D3GKV.15.16.B05.1.454.CMB.2.raw
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttcttgttgctattttagaaggtgtccagtgtgaggtgcaacgtggtggagtcgtgggggagcctcgtccgaggccggggggtccctgagctctccgtgtgaagcctcgtggacttcaccttgagctacttattggatgacgttgggtccgcgaggcctccgaagggggaaggggctgggaggtgggtggacccaacgaataaacaaaaagntagggaaagtgaacaacgaaacctagtaggtanaacgtcgtagtggagttcgggggactactttacccgacccggtctaccgaaaggacgaaccgacggaaccaaacgaaactacaacctaaccattccaagaacctaaaagtacgaaaacctaaccgaggaacgacgaccgaaggaccgacggcttgtagtaattcgngttgngaagtgttagttgttcgtggtcgggttcggggcctacggggacccgttggttccgtaacccg

SEQ ID NO: 306632 - DNA, 669 bp, Homo sapiens
  misc_feature: GZ8MTXP01APLMF.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgaggccggggggtcctgagactctcctgtgaagcctctggacttcacttgagctacttattggatggacgttcgggtcccgccgaggccgtccggaagggggaacgggggcgtggggacgggtgggggtcggacccgaaccaaagttaaacgaaaaaagagtaggaaacgtacgaacaacctaaacctatagtagtaacctcgtgtgagtcggggacctacgtttcccgacccgtctacccgaaggacgaaccggacccgaacccgaaacgaacctaccaactacattccagaacaaatacgaaacaacctaggaacgacggaccggaaaggaccgtacgggtcttaggttcttaaagttagttggtgttaggaagtagttagttcgttcggtcggtcggggtcgggaccgaacgggttccctcgggttccctaaccccgg

SEQ ID NO: 306633 - DNA, 607 bp, Homo sapiens
  misc_feature: GZ8MTXP01BZRMP.15.16.B05.1.454.CMB.2.raw
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
tcagtctacgtagccacgaccggtgctcgatttagagctcacgtattgggtttgaggtctcagagaggagccttagccctggactccaaggcctttccacttggtgatcagcactgagcacagagactcaccatggaattgggctgagctgggttttccttgttgcttattttagaaggtgtccagtgtgaggtgcaacgtggtggagtcgtgggggagcctcgtccgaggccggggggtcctgagctctctgtgagcctctggattcaccttgagctacttatgatgacgttgggtccncgaggctccgagggggaaggggcgtgggaggtgggtcggacccaaccgaataaacgaaaaaagngtaggaaagtgaacaacaacctatagtanaactntgngagtcgggacctattccaccgtcaccagacgaccgacgaccgaagaacctcaacttacagtacctagacgaaatacgaaaccaaccgtagaacgcgtaccggaacggacgtcggtactggtataacgttagttgtgttgaagtcgttagttcggttcgtggtcgggttcggggccgacggggttacccgtcgggttcctaaccccg

SEQ ID NO: 306634 - DNA, 605 bp, Homo sapiens
  misc_feature: GZ8MTXP01BQ0QR.15.16.B05.1.454.CMB.2.raw
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtcctgagactctcctgtgacgcctctggattcaccttgagctacttattggatgacgttgggtccncgaggctccgagggggaggggctgggaggtgggtcggccaacataaacgaaaaagntaggaacgtgacacaacctatacgtagaactctggtgtagtcgggaccgtattccgacccgtctccgaagacgaccgacggaccaaagtaacctcaacacatctagacaaatacgaaactaaccgtgaaggcgaccggaagcgacgggcttggtcgtaattagnggtaggngaaggtgttagtttggttcgtggtacgggttcggggacccgacggggttacccctgggttcccgtaacccg

SEQ ID NO: 306635 - DNA, 614 bp, Homo sapiens
  misc_feature: GZ8MTXP01EO0TZ.15.16.B05.1.454.CMB.2.raw
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (511)..(511): a, c, t, g, unknown or other
  misc_feature (511)..(511): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaagtggtggagtcgtgggggagcctcgtccgaggccggggggtcctgagactctcctgtgaacgcctctggacttcaccttgagctacttagttggatgtacgttcgggtccnccgaggcctccgagggggagggtctgggaggtgggtcgaccaaccaataaacgaaaaaggngtaggaagtgaacaactaaacctatagtanaactntgtgagtcgggacctattaccaccgtctaccgagacgacgacgaaccaaagacctcaacacatctagaacaaatcgaaaactaccgagaacgacgccggaaagcnggtactgtacgttaattacgttggtagttgtaggtaattggttgttccgtgggtccgggttcggggaaccgaccgggttaacccgttgttccccgttaacccg

SEQ ID NO: 306636 - DNA, 617 bp, Homo sapiens
  misc_feature: GZ8MTXP01BW9MU.15.16.B05.1.454.CMB.2.raw
  modified_base (374)..(374): a, c, t, g, unknown or other
  misc_feature (374)..(374): n is a, c, g, or t
  modified_base (507)..(507): a, c, t, g, unknown or other
  misc_feature (507)..(507): n is a, c, g, or t
  modified_base (535)..(535): a, c, t, g, unknown or other
  misc_feature (535)..(535): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggcctcgtccgaggccgggggtccctgagactctcctgtgacgcctcgtggattcaccttgagctacttagttggatgtacgttcgggtcccgccaggcctccggagggggaggggctgggaggtggggtacgcccaacaataaacaaaaagngtaggaaagtcgaacacaaccgtatgtacgaactcgtgtgacgtcgggacccgtattcccacccgtctaccgaggacggaccgacgaccaaagaacctccaacttacgatctgaacaaatagaaaccctaacnggaagaccgaccggaggaaccgacggtnttcggtagttaacttgttgtggttagagagttgttgttcgtgggtcggtaacggggccgacgggacccgttggccgttcccg

SEQ ID NO: 306637 - DNA, 573 bp, Homo sapiens
  misc_feature: GZ8MTXP01DYMDM.15.16.B05.1.454.CMB.2.raw
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (504)..(504): a, c, t, g, unknown or other
  misc_feature (504)..(504): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaatggtggagtcgtgggggagcctcgtccgaggccggggggtcctgagactctcctgtgaagcctctggattcaccttgagcacttattggatgacttgggtccnccaggctccgagggggaaggggctgggagtggggtggcccacataacaaaaagntggaaacgtgacanaaccctatgtagaactctggtgatggggccattcaccgtctaccagagacgacgaccaaagactcactacagtctagacaaatcgaaacaacctgaacgaggaccgtaaggactacgggctagtgtaacttagngtgttgaagtgacgttggttctggtccgggttggggccgaggggttaacccctggggttccctaacccg

SEQ ID NO: 306638 - DNA, 588 bp, Homo sapiens
  misc_feature: GZ8MTXP01AVZ9Y.15.16.B05.1.454.CMB.2.raw
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgaagcctctggattcaccttgagcacttattggatgacgttgggtccgccaggctccgaggggaggggctggagtgggtgccacataacaaaagagtaggaagtgacacaacctatagtagaactctaggtgagtcggggaccgtattcccaccgttctaccaggacgacgacgaccaaagacctcaactacatctgacaaatcgaaacacctagagacgaccgaggacacggctgtcgtaattacgnggttgnggagtagttagttcggttacgtgggtcgggttcgggggacccacgggggttaacccctggggttcccgttaaccccgg

SEQ ID NO: 306639 - DNA, 582 bp, Homo sapiens
  misc_feature: GZ8MTXP01C0E34.15.16.B05.1.454.CMB.2.raw
  modified_base (361)..(361): a, c, t, g, unknown or other
  misc_feature (361)..(361): n is a, c, g, or t
  modified_base (467)..(467): a, c, t, g, unknown or other
  misc_feature (467)..(467): n is a, c, g, or t
  modified_base (519)..(519): a, c, t, g, unknown or other
  misc_feature (519)..(519): n is a, c, g, or t
  modified_base (530)..(530): a, c, t, g, unknown or other
  misc_feature (530)..(530): n is a, c, g, or t
  modified_base (542)..(542): a, c, t, g, unknown or other
  misc_feature (542)..(542): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattccaccttgagcacttagttggatgtacttgggtccgccgaggctccgaggggaaggggctgggagtgggtggccaacgataacaaaaaagntagggaagtgaaaacacgaaaccctatagtgaacctctggtagatggggaccaattcccgaccgttctacccagacgacgacgaccaaagactacacttacatacngacaaatcgaaacaacctgagacgccgaaggacgacggctggtgtaattacnggtgttgaagngagttcgttcgngtcggttggggccgaggggaccccgtggttccgtaacccg

SEQ ID NO: 306640 - DNA, 584 bp, Homo sapiens
  misc_feature: GZ8MTXP01EZUDD.15.16.B05.1.454.CMB.2.raw
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtcctgagactctcctgtgaagcctctggattcaccttgagcacttatggatgacttgggtccncaggctccgagggggaaggggctggagtgggtggccaccataacaaaaagntaggaacgtgacacgaacctatgtagaactctggtgagtcggggccctaattcccgaccgtctaccgaaggacgaccgacgacccaaagaacctcaactacatctagacaaatgaaaccaccgtgagacgccgaaggacacggtctggtcgtaattacgttggtgttagagagttagttgttcgtggcgggttcggggcccaggggacccctgggttccctaaccccgg

SEQ ID NO: 306641 - DNA, 560 bp, Homo sapiens
  misc_feature: GZ8MTXP01EBSIR.15.16.B05.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgagcacttattggatgacttgggtccncaggctccaggggagggctggagtgggtgccacataacaaaaagnaggaagtgacacaacctatgtnaactctgngatgggcattcacgtctcagagacgacgacaagactcactacatctgacaaatgaaaccaacctgaagacgccggaaggacacgggctgtgtaacttagttggtgttgaaggtattagttgttcgtggtcgggtttcgggggccctacgggggaacccttcggggttaacctaaccccgg

SEQ ID NO: 306642 - DNA, 765 bp, Homo sapiens
  misc_feature: GZ8MTXP01A9I24.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagccgtcgtccgaggccgggggtcctgagactctcctgtgagcctgtggattcaccttgagctacttagttggatggtcgttcgggtcccgcgaggccgtaccggaagggggaagggggtcgtaggggaggttcgggggtccggacccgaaaccgaagtaaacgaaaaaaggagtacgggaaagtacggaaaccaacctaaacccgttagtaacggtacgtaaccgtcgttagggtaggtacggtcgggggtacccgttaacgtttacccgaccccgtttaccgtaacccgaagggaaccggaaaccccggaaccggaaaccccgaaaacggtaaacccttaaccgtaaaccgtaacctaacgttacgttaaacgaacctaaaaagttaccgaaaacccaaaccgttaggaaacggacggacccggaaacggaccgtaacgggtcttaggttacgttaacgttaagttggtagttgaagtagttacgtttgttcgtaaggtcgggttcgggaccgtaccgggttaacccgtcggttaaccgtaacccg

SEQ ID NO: 306643 - DNA, 615 bp, Homo sapiens
  misc_feature: GZ8MTXP01A7MRV.15.16.B05.1.454.CMB.2.raw
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttattggatgacttggggtccgccaggctccgagggggaaggggctggagtggggtcggccaccataacaaaagagtggaaagtgacacaacctatgtagaactctgtgagtcggggcctattccaacccgttctaccgaagagaccgacgaccaaagaacctcaactaccatctgactaaatcgaaaccacctagaacgacgccggaaggaccaccgggnttggtcgtaatttacgttggttaggngtaaggtagagtttcggttcgtcgggtcggggtttcgggggcccgaacggggggttaacccctcggggttcccgtaaccccgg

SEQ ID NO: 306644 - DNA, 546 bp, Homo sapiens
  misc_feature: GZ8MTXP01BCV1O.15.16.B05.1.454.CMB.2.raw
  modified_base (351)..(351): a, c, t, g, unknown or other
  misc_feature (351)..(351): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggcctcgtccgaggccgggggggtcctgagactctcctgtgagcctctggattcacttgagcacttattggatgacttggactccgccaggctccgaggggaagggctggagtgggtggccacataacaaaagntggaagtgacacaacctaatgtgaactcgtgtgagtcggggccgtattccaccgtctccgagacgacgacgaccaaagactcactacgatcnggacaaagtagaacaacgngagacgacgagcngtntgtaattattgtgttgngagagttnttggttcgtggtcgggttcgggaccgacgggtccgttcgtccg

SEQ ID NO: 306645 - DNA, 635 bp, Homo sapiens
  misc_feature: GZ8MTXP01DI8P1.15.16.B05.1.454.CMB.2.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
  modified_base (512)..(512): a, c, t, g, unknown or other
  misc_feature (512)..(512): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtgggtggagtcgtgggggagcctcgtccgagggccggggggtcctgagctctcctgtgacgcctctggattcacttganctacttatggatgacgttgggtcccncgaggctaccggagggggaacggggctggaggtggggtcggacccaaccgaaagtaaacaaaaaaggngtaggaaacgtcgaaacaactaaacctagtagtacaactcgtaggtgagtcggggacgtacttcccgaccgttctaccagaacgacgaccgaccaaagtactcaactacatcgtagaacaaatacgaaacctaacgngaacgacgacccggaaggacctacggcttgtacgttaattacgttggtgttgaagtacgttagttcggttactgggttacggttccggggacgtaccgggttaccctcgggttcctaaccccg

SEQ ID NO: 306646 - DNA, 703 bp, Homo sapiens
  misc_feature: GZ8MTXP01A4VLI.15.16.B05.1.454.CMB.2.raw
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcctcgtccgaggccggggggtcctgagctctcctgtgaagcctctggacttcaccttgagctacttagttggatgtacgttcgggtccgccgaggcgtaccggagggggaggggcgtgggaggtgggggtcgaccaactaataaacgaaaagngtaggaacgtagaacacaactatagtacaactcgtagtgacgtcgggacctattccgaccgtcnccgaaggacgacgacgtacaaagaccncaacctacatactacganaaaactcggaaaccaaccgtaggaacgacgggaccggtaaacgggaccgtaaccgggtcttacggttcggttaaacgttacgttagggttgggttacggaaagggtacggttaagttttcgggtttaccgggttcgggggtaccgggggttttaacccggggggacccgtaaacccggggggttaaccccggttcgggttaaaccccggttcccccggg

SEQ ID NO: 306647 - DNA, 643 bp, Homo sapiens
  misc_feature: GZ8MTXP01DK1U6.15.16.B05.1.454.CMB.2.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (545)..(545): a, c, t, g, unknown or other
  misc_feature (545)..(545): n is a, c, g, or t
  modified_base (556)..(556): a, c, t, g, unknown or other
  misc_feature (556)..(556): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggaggtcgtgggggaggcctcgtccgaggccggggggtccctgagactctcctgtgancctntgatcnctganctactatgatgacgttcggccgccgaggcgtacggaggggacgggtgtgggaggtgggtcgaccaacctaaagtaaaacgaaaagagtaggtaacgtacgaacaaccgtaactagtaacgtacgtaactcgttgagtacggtacggcgtactccgaccttcacggaagacgaacgaccgaaacgaacgtaacctacgaactacgatacgtaacgaaataaacgtacgaaaccacgtagagacggaccggtacgaccgtgcgttagtnttaatttcggngtgaggtaaggtgttacggtttcgttacggtcgggtacgggtccgggggaaccgtaccggggttacccgttcggttaacccttcccg

SEQ ID NO: 306648 - DNA, 625 bp, Homo sapiens
  misc_feature: GZ8MTXP01EY9QK.15.16.B05.1.454.CMB.2.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagcctcgtccgaggcccggggggtccctgagactctcctgtgagcctctggattcacttgagctacttatggatggacttggggtccnccgaggcctccgagggggaaggggctgggaggtgggtcggcccaaccgataaacgaaaaagngtaggaaagtgaacaacaacctatagtagaacttcgtgtgagtcgggccgtattccaccgtctccaagacgaaccgacgacccaaagaactaccaactacatacgtagaactaaatacggaaaccaaccgtaggaacgacggaccggaaggacgaccgggtctggtgttaattacgttggtgttagagtacgagtttcggttcgtgggcgggttcgggggccgtaacggggttaccctcggggttccctaaccccg

SEQ ID NO: 306649 - DNA, 668 bp, Homo sapiens
  misc_feature: GZ8MTXP01AUWQH.15.16.B05.1.454.CMB.2.raw
  modified_base (518)..(518): a, c, t, g, unknown or other
  misc_feature (518)..(518): n is a, c, g, or t
  modified_base (595)..(595): a, c, t, g, unknown or other
  misc_feature (595)..(595): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccgggggggtccctggagactctcctgtgacgcctctggattcactgagctacttattggatgacgttcgggtccgccgagggccgtccggaagggggaacgggggcgtagggggaggttgggggcggacccaaccgaataaaccgaaaaaaggagtaggaaagtgaaacactaaaccgtatagtacgaacttcgtgggtaggagtcgggggaccctacttacccgacccgtcctaccgaaggacggaaccgaaccgacccaaagtacctcaacttacactacgtanaacaaagtacgaaaccctaaccgtaggaacggacggaccggaacggtaccgaccgggtcttggtagttaatttacgngtaggttagagtgttagtttgttaccgtcggttcggttcggggcgtaccgggacccgttcgggcctaacccgg

SEQ ID NO: 306650 - DNA, 689 bp, Homo sapiens
  misc_feature: GZ8MTXP01D9XOF.15.16.B05.1.454.CMB.2.raw
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
tcagtctacgtagccacgaccggtgctcgatttagagctcacgtattgggtttgaggtcccagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcctcgtccgaggccggggggtcctgagactctctgtgagcctctggattcaccttgagcacttatggatgacgttgggtccncaggctccgaggggagggctggagtgggtgccacataacaaaaagntggaagtcgacacaacctatagtagaaactcgtgtaggagtggggacccgtatttccgaacccgttctacccgaaggacgaaccgtaaccgaccaaaagaaaccttcaaaccttaacaaacttccgtaaaagggaaaacttacgggggaaaaacccaaacccgttaggaaacgggacggaacccggtaagggaacccgaaaccggggtccttaggtttaggttaaactttcgtaagggtttgttaggaacgttagtaagtttcccggtttgcggttcggggttcgggggacccgtaacgggggtaccccgtagggttccctaacccggttccttccccg

SEQ ID NO: 306651 - DNA, 599 bp, Homo sapiens
  misc_feature: GZ8MTXP01CD3AZ.15.16.B05.1.454.CMB.2.raw
  modified_base (305)..(305): a, c, t, g, unknown or other
  misc_feature (305)..(305): n is a, c, g, or t
  modified_base (360)..(360): a, c, t, g, unknown or other
  misc_feature (360)..(360): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgaagcctctggattcaccttgagctacttattggatgtacttgggtccnccaggctccgagggggaaggggctgggaggtgggtcggccaccataacaaaaagntaggaaacgtgacacaaaccctagtagtagaactcgtgtgagtcggggacctattccaccgtctaccgagacgacgacgaccaagaactcaactacatctagacaaatcgaaaccaaccgtgaagacgaccggaaggacacggtctgtcgttaattacgttggtgttgagtagttagttggttcgtgggtccggttgggggcccgtacggggttaacccgttgggttcccgtaacccgg

SEQ ID NO: 306652 - DNA, 705 bp, Homo sapiens
  misc_feature: GZ8MTXP01BTBP1.15.16.B05.1.454.CMB.2.raw
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggacgcctcgtccgaggccggggggtcctgagactctcctgtcgagcctcgtggacttcaccttgagcacttagttggatgacgttcgggccnccgaggcctccggagggggaacgggggctggggaggtcggggtcggacccaaccgaataaacgaaaaagngtaggaagtgaacacaaactntaagagaactcgtgngagtcggggacctattcccaccgttctaccgagacgaacgaccgacgaaacgactacaactacactcgtagacaaagtacggaaaccaaccgtagaacggacgaccgggtaaggacccgaacgggtccgttaggtcgttaaacgtttacgttagggttacgttggaaacggtaggttaacgtttcggggttttacccgtgggggtttacccggggtttaaccggggggaaccccgtaaaccggggggttaaaccccccgtttgggggttaacccccgtttaaccccccggg

SEQ ID NO: 306653 - DNA, 655 bp, Homo sapiens
  misc_feature: GZ8MTXP01AL9BT.15.16.B05.1.454.CMB.2.raw
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
  modified_base (573)..(573): a, c, t, g, unknown or other
  misc_feature (573)..(573): n is a, c, g, or t
  modified_base (587)..(587): a, c, t, g, unknown or other
  misc_feature (587)..(587): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcgttgggttttccttgttgcttattttagaaggtgtccagtgtgaggtgcaacgtggtggagtcggtgggggacgccgtccggtccgacgggtcccggggggtcctggacgtactctccgtgtgaacgtcctcgtggtacttcaccgttganctactttagttggatcggtacgttcgggtccccgcgacggtcctaccggaagggggaacgggcgtgggagggtgggtacgacccaacgaagtaaacgaaaagtgtacggaatcgaacaacctaactntaagtacgtaacctgtagtgacgtcgggtacctacttccgtaccgtctaccgagacgaaccgacgaaccgaaagtacctactaactaactactacagtaacaaacgttacgaaacctaacgagagacgacggagacgtcggtntggtattaacttgngtgagtacgtagttgttcggttcaagggtcgggtcgggtacgacgggttacctcggttccctaacccg

SEQ ID NO: 306654 - DNA, 701 bp, Homo sapiens
  misc_feature: GZ8MTXP01D0BWC.15.16.B05.1.454.CMB.2.raw
  modified_base (381)..(381): a, c, t, g, unknown or other
  misc_feature (381)..(381): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgagggccggggggtccctgagctctcctgtgaacgcctcgtggtacttcaccttgagctacttattggatgtacgttcgggtccgccgaggccgtccggagggggaagggggcgtagggaggtgggtcggaccaaccgaagtaaacaaaaagngtaggaaacgtcgaaacaactaaaccgtatagtacaacttcgtaggtcgagtcggggaccgtacgttaccacccgttcgaaccgaacggaacgaaccggaaccgaacccgtaaaacgtaaaccttcaacctaaactactactacgaactaaaatacggaaaaccaaaccgtagaacgacggacccggtaaaggaccgaaggtcgttaggttagttaatttagttggtaggttagaaggtaagttgtttgggttcgtaacggggtcgggttaacgggggtacccggacgggggttaaccccgttggttaaccccgttcccg

SEQ ID NO: 306655 - DNA, 809 bp, Homo sapiens
  misc_feature: GZ8MTXP01EH0IS.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgtctattttagaggtgtcagtgtgaggtgcaacgtggtggagtcggtgggggacggccgtcgtccgacgggccggggggtccctggagtactctccgtgtgacgcctcgtggtacttcacttgagctacttattggattcggtacgttcggggcccgccgaggccgtaccggaaggggggaacgggggtcgtagggggtacgggtgggggtaccggtacccgaaccgtaaagttaaaacgaaaaaaaggaaggttaacggggtaaaacgtacgggaaacctaaaccgtaaacccgttaagtaacggttaacgtaacgttccgttagggtacggtacggtacggggtacccgtactttacccgaacccgttctaaccgaagggaaccggaaccgaaaccggacccaaacgtaaacctacctaaactaacgtaactaccgtacgaaacgtaaaacgttacgaaaccgaacccgtagaaaccggaaccgaccgggtaaacggaccgtaccgggtcttaggttagttaacgtttacgttggtaggttacggaagttaggttacgttcggtttacgtaacgggttcggggttaacccggggaacccggttaacggggttaccccgttcggttccccggttaaccccg

SEQ ID NO: 306656 - DNA, 642 bp, Homo sapiens
  misc_feature: GZ8MTXP01AZO3D.15.16.B05.1.454.CMB.2.raw
  modified_base (386)..(386): a, c, t, g, unknown or other
  misc_feature (386)..(386): n is a, c, g, or t
  modified_base (585)..(585): a, c, t, g, unknown or other
  misc_feature (585)..(585): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagactctccgtgtgagcctctggacttcaccttgagcacttattggatgtacgttcgggtcccgccgaggcctaccggagggggaagggggcgtaggggaggtcgggggtcggacccgaaccaagtaaaccgaaaaaaggngtagggaaacgtagaacaacaaccctagtagtacgtaactcgtaggtagtagtcggggacccgtatttcccgacccgttcctaccgagacgaccgaccgaccaaacgaacctcaactacatctagaactaaagtacgaaaccaacgtagaagacgaccggaaggactaacggctggtgttaacttagttgtgttgaagngttagttcgttcgtggtcgggttcgggaccgtacgggaccctcggttccgtaacccg

SEQ ID NO: 306657 - DNA, 636 bp, Homo sapiens
  misc_feature: GZ8MTXP01A6ZMB.15.16.B05.1.454.CMB.2.raw
  modified_base (300)..(300): a, c, t, g, unknown or other
  misc_feature (300)..(300): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccaggccggggggtcctgagctctcctgtgagcctctggattcacttgagcacttatggatgacttgggtccncaggctccgagggggaagggctgggagtgggtcgccaacataacaaaaagngtggaaacgtgacacaacctanagtacgaactcgtgtagacgtggggacccgtatttcccgacccgtctacccgagacgaccgacacccaaagaacctcaactacaattctagacaaaagtcgaaaccaccgtagaacgacgaccgtaacggacgtaacgggtcttagggtgttaacgttaacgttggttaggttacggaaggtaacgttagtttggtttccgtgggtccgggtttaacgggggccctaacgggggaacccccgttggggttaaccctaaccccg

SEQ ID NO: 306658 - DNA, 709 bp, Homo sapiens
  misc_feature: GZ8MTXP01CGXYM.15.16.B05.1.454.CMB.2.raw
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagctctcctgtgagcctctggattcacctgagcacttattggatgacgttcgggccncgaggctccgaggggaggggctgggaggtgggtgccacgataacaaaagntaggaacgtcgacaacgtaaccctagtacgtagtaaccttcgtaggtaggtagtcgggggccctaacgtttcccaccccgttaccgtaccccgaaggaaccggaaccggaacccgaaccccgtaaaacgaaaccctaccaacccttaacaacttctaacgaaccgtaaaactcggaaaaccctaaacccgtggaaaccggacggacccggaaacgggaccgtaaccgggtctggttacgttaactttacgttgggttggttaggtaaggtagttagtttcgggttccgttggggtccgggttttcgggggacccgttaaccgggggacccccgttcggggttcccgttaacccccgg

SEQ ID NO: 306659 - DNA, 617 bp, Homo sapiens
  misc_feature: GZ8MTXP01CYO7Z.15.16.B05.1.454.CMB.2.raw
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcgttgggtttttccttgttgcttattttagaaggtgtccagtgtgaggtgcaactggtggagtcgtgggggagcctcgtccgagggccggggggtccctgagactctctgtgaagcctgtggattcaccttgagcacttattggatgacttgggtccnccaggctccgaggggaggggctgggagtgggtgccaccaataacaaaaaagntaggaaagtgaacacaaacctntagtagaactctggtgagtcggggcctatccctaccgtcnccgaagacgacgaccgaccaaagaacctcaacttacatcctagaacaaatacgaaacaaccgnggaagacggccgaaaggcctaacgggctaggtntaattaacgttggtagttagagtaaggttattcggttacgtgggtccgggtttcgggggccccaaggggttaacccccgttgggttccctaacccccg

SEQ ID NO: 306660 - DNA, 712 bp, Homo sapiens
  misc_feature: GZ8MTXP01EFIAO.15.16.B05.1.454.CMB.2.raw
  modified_base (625)..(625): a, c, t, g, unknown or other
  misc_feature (625)..(625): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgagtgcaacgtggtggagtcgtgggggacgcctcgtccgacggccggggggtcctgagactctcctgtgaagcctcgtggattcaccttgacgctacttagttggatggacgtttcggggtcccgaccgaggtccgtaccggaaggggggtaacgggggccgtagggggagggttcggggggttacggacccctaaaccgaaagttaaaaccgaaaaaaaggagtaggggtaaaccgtacggaaaccaaccgtaaaacccttagtaagtaacgtaacttcgtggtacggagtcggggacctactttcccgaccccgtctacccgaaggaccgaacgacccgaaccgaaacgtaactaccaaactacacttacacgaactaaaactacgaaaacccgtaccgtaggacggacgaccggaaaggtacctacgggtnttagtgttaacttgttggtagttagagtagttcgttcggttcggtcgggtcgggtcggaccggacgggttaccgtcgttcccgtccg

SEQ ID NO: 306661 - DNA, 617 bp, Homo sapiens
  misc_feature: GZ8MTXP01EPE29.15.16.B05.1.454.CMB.2.raw
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
  modified_base (509)..(509): a, c, t, g, unknown or other
  misc_feature (509)..(509): n is a, c, g, or t
  modified_base (539)..(539): a, c, t, g, unknown or other
  misc_feature (539)..(539): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccgaggccggggggtccctgagactctcctgtgaagcctcgtggattcaccttgagctacttagttggatcggtacgttcgggtccaccgaggccgtaccggagggggaaggggtcgtgggaggtggggtcggacccaacgataacaaaaagngtaggaagtagacaacaactntaagtcgaactctgtgagtcggggactactttcgacccgttnacgagagaccgacgaacccaaagtactccaactacactacgtagaacgtaaaatcggaaactaccgngaacgacgacgaggaccgtacgcttaggtntaacttagttggtgttagagtagagtttggttcgtggtcgggttcgggacgtacgggaccctcggttcccgtaacccg

SEQ ID NO: 306662 - DNA, 597 bp, Homo sapiens
  misc_feature: GZ8MTXP01CWD7K.15.16.B05.1.454.CMB.2.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (492)..(492): a, c, t, g, unknown or other
  misc_feature (492)..(492): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagctctcctgngagcctnggatcaccttgagcactnttggatgacttggtccgcgagctccgagggaaggggcgtggagtgggtgccaacgataacaaaaaagntaggaagtgacanaacctataagtnaactctggtnagtcgggaccgattcccgaccgttctccgaggacgacgaccgaccaaagaactcaactacgatctagacaaagtacgaaacaaccgtagaacgacgaccgaaggtacncgggtactgtgttaattcttagggttgttagagtagttacgttgttacggtcggtacggttcgggggaccgaacggggttacccgttcggttaaccgtaaccccg

SEQ ID NO: 306663 - DNA, 668 bp, Homo sapiens
  misc_feature: GZ8MTXP01BVLOI.15.16.B05.1.454.CMB.2.raw
  modified_base (388)..(388): a, c, t, g, unknown or other
  misc_feature (388)..(388): n is a, c, g, or t
  modified_base (544)..(544): a, c, t, g, unknown or other
  misc_feature (544)..(544): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgctattttagaaggtgtccagtgtgaggtgcaacgtggtggagtcggtgggggacggcctcggtccgacggggcccggggggtccctggagactcctcctgtgaagtcctcgtggacttcaccttgagcctacttagttggatgtacgttcgggtcccgccgacggcctaccggagggggacggggctggggacggtgggtcgccaaccgaataaacaaaagngtaggaacgacgacaaccaaaccgttagtaacgtagtaactcgtaggtcggtacgtcgggtaccgtacttacccgtacccgttcacccgaaggagaaccgaccgaacccgtaaagacctcaaactctacgtcaggtacaaagtcgaaaccgtaccnggaaccggcggaccgaagggtaccgacgtgtagtacgttaattgttaggtggagaacgtagttgttggttcgtaaggccggggttaacgggaccgtacggggttaccctcgggttcccgtaacc

SEQ ID NO: 306664 - DNA, 670 bp, Homo sapiens
  misc_feature: GZ8MTXP01DXAGJ.15.16.B05.1.454.CMB.2.raw
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
  modified_base (490)..(490): a, c, t, g, unknown or other
  misc_feature (490)..(490): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtcagtgtgaggtgcaacgtggtggagtcgtgggggagcctcgtccgagggccgggggggtcctgagtactctcctgtagaagtcctcgtaggtattcaccttgacgctaacttagttggatggtacgttcgggtccnccgaggcctacggagggggaaggggctagggaggtgggtacgaccaacgaaataaacaaaaaagntaggaaagtcgaaacaacaaaccttagtaggtaataactctagtcgaagtcggggacctattacccaccgttcaccgaagacgaaccgtaacaaccaaataaccncaaacctaacgaactaccgtaaanaaacgtaaaacgtaacgaaaaccaacgtaggaacgaccgaacggtaagaccgtacggtctaggttataagttcgttggtaggttagaaggtagttacgttcgttcggtcgggtacgggtaacgggaccgaacgggttaccgttcggaacccgtccg

SEQ ID NO: 306665 - DNA, 766 bp, Homo sapiens
  misc_feature: GZ8MTXP01AHDVC.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgctattttagaaggtgtccagtgtgaggtgcaacgtggtggagtcgtgggggacgccgtcggtccgacgggcccgggggggtcccctggacgtactctcctgtagaagcctgtggattcaccttgagctacttagttggactcggtacttcgggtcccgcgacggcctccggagggggaagggggtccgtagggagggtcggggtcggacctaacccgaagttaaacgaaaaaagtgtacgggtaacgtagaaccgaacgtaaacccttagtaacggttacgaacttccgtgggtaggaacgttcggggacccttacgttcctacccggttactaccgaaggtaacggaacccggaaccgacccgtaaacgtaacctacctaaacctacctaacttaccggttacaaacgtaaagtaaccggaaaccaaaccccggttaggaaccggaccggtaccggtaaaccggaccgtaacccggggttcgttaacggttagtttaacgttacggttaggtagttacggtagtacggttacgtttcgttacggtcgggtaccgggtccgggtacccggtaccgggttacccgttccggcccgtaaccg

SEQ ID NO: 306666 - DNA, 536 bp, Homo sapiens
  misc_feature: GZ8MTXP02GLWBA.15.16.B05.1.454.CMB.2.raw
  modified_base (351)..(351): a, c, t, g, unknown or other
  misc_feature (351)..(351): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
tcagtctacgtagccacgaccggtgctcgatttagagctcacgtattgggtttgaggtctcagagaggagccttagccctggactccaaggcctttccacttggtgaccagcactgagcacagaggactcaccatggaattggggctgagcgtgggttttccgttgttgctatttagaaggtgtccagtgtgaggtgcaactggtggagtctgggggaggcctcgtccaggccggggggtccctgagactctcctgtgaagcctctggattcaccttgagcacttatggatgacttgggtccgccaggctccgagggaaggggctggagtgggtggccaccatacaaaagntggaagtcgacacaactatgtgaactctgtgatggggccattcacccgtctccagagacgacgcccaagaacctcactacatctagcaaananaacaacagagacgacgacggacgacgcgtgtgtatactgtgtgagagagtgtgtgtcggtcgggacggacggaccgtacggtcgtaccgtcg

SEQ ID NO: 306667 - DNA, 528 bp, Homo sapiens
  misc_feature: GZ8MTXP02JZGBN.15.16.B05.1.454.CMB.2.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccaggggaaggggctggagtgggtgggccaccatacaaaaagntaggaagtgacacaaacctatgtgactctgtgatggggccgattcacccgtctccagagacgacgccaagactcactacatctgcaaatgaaacaacctgagagccgaggacacggctgtgtattactgtgtgagagactgttctgcgttcggggccagggaccctgggtcacccg

SEQ ID NO: 306668 - DNA, 571 bp, Homo sapiens
  misc_feature: GZ8MTXP02G7ZVH.15.16.B05.1.454.CMB.2.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaggggctggagtgggtggccaccataacaaaaagntggaaagtgacacaacctatgtgacttntgtgagtgggactattccaccgtcncgagagacgacgacaagtactacaactacatcgtagacaaataacgaaacaacctacgacgacgacggacggacgacggacgtgtagttacgttacgtagtagtagagagtagttgttcgtggtcggtacggggtacggacgggtaccggtaccggtaccgtaccg

SEQ ID NO: 306669 - DNA, 525 bp, Homo sapiens
  misc_feature: GZ8MTXP02JNMB6.15.16.B05.1.454.CMB.2.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttggggtccgccaggctccaggggaaggggctggagtgggtggccacatacaaaagntggaagtgacacaacctatgtgactctgtgatgggccgattcaccgtctcccagagacgacgcaagaactcactacatctgacaaatgaacaacctgagagccgaggacacggctgtgtattactgtgtgagagatgttctgcggttcggggccagggtacccctggactacccg

SEQ ID NO: 306670 - DNA, 524 bp, Homo sapiens
  misc_feature: GZ8MTXP02JPYK5.15.16.B05.1.454.CMB.2.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgactgggtccncaggctccgaggggaggggctggagtgggtggccaccataacaaaaagntaggaagtgacacaaacctatgtgactctgtgatgggccattcaccgtctccagagacgacgacaagaacctcactacatactgacaaatgaacacctgagacgccgagacaggctgtgtatactgtgtgagagatattgtgtcgttcggggaccagggaccctcggctacccg

SEQ ID NO: 306671 - DNA, 518 bp, Homo sapiens
  misc_feature: GZ8MTXP02GBU1Y.15.16.B05.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccncaggctccgagggagggctggagtgggtggccaccataacaaaaagntaggaagtgacacaacctatgtgactctgtgatgggcgattcacgtctccagagacgacgacaagactcactacatctgacaaatgaacaactgagagccgaggacacggctgtgtattacngtgtgagagatcgttgngcggttggggccagggaccctggtcaccg

SEQ ID NO: 306672 - DNA, 532 bp, Homo sapiens
  misc_feature: GZ8MTXP02HJGYG.15.16.B05.1.454.CMB.2.raw
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgttagctatttagaaggtgtcagtgtgaggtgcaactggtggagtcgtgggggaggcctcgtccaggccgggggggtccctggagactctcctgtgaagcctctggattcaccttgagcacttattggatgacttgggtccgccaggctccgaggggaaggggctggagtgggtggccacataacaaaaagntaggaatgacacaactatgtgactntgtgagtggccgattcaccgtcnccagagacgacgccaaagaacncaacacatctagacaaananaacaacagagacgacgacgacgacgacgtgtagtactagtgtgtagagagagtgtcgtgtcggtcggacggacggaccgtacgtacgtcg

SEQ ID NO: 306673 - DNA, 521 bp, Homo sapiens
  misc_feature: GZ8MTXP02HZM7I.15.16.B05.1.454.CMB.2.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttctgttaggctatttagaaggtgtccagtgtgaggtgcaactggtggagtcgtgggggaggcctcgtccaggccgggggggtcctgagactctcctgtgagcctctggattcaccttgagcacttatggatgacttgggtccncaggctccgaggggaggggctggagtgggtggccacataacaaaaagntaggaagtgacacaactatgtgactngtgatgggccattcacgtcnccagagacgacgaccaagactcactacatcngacaaaatgaacaaccagagagacgacgacgacgcgtgtgtatatgtgtgagagatgttcgtgtcggttcgggcgacggaccgtcggtacgtccg

SEQ ID NO: 306674 - DNA, 546 bp, Homo sapiens
  misc_feature: GZ8MTXP02H5WEK.15.16.B05.1.454.CMB.2.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (472)..(472): a, c, t, g, unknown or other
  misc_feature (472)..(472): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggttttcctgttgctattttagaaggtgtccagtgtgaggtgcaactggtggagtctgggggaggcctcgtccaggccgggggggtccctgagactctcctgtgaagcctctggattcaccttgagcacttattggatgacttgggtccgcaggctccgaggggaaggggctggagtgggtggccacataacaaaagntaggaagtgacacaacctntgtgactctgtgatgggccgattcaccgtctccagacgacgacgaccaagactcactacatctgacaaatgaaaccaactgaagacgaccgaggacacggngtgtagtacttacgtgtgtagacgagtattcgtcgtggtcggtcggggaccgacgggtaccgtcggtacctccg

SEQ ID NO: 306675 - DNA, 528 bp, Homo sapiens
  misc_feature: GZ8MTXP02GYRA9.15.16.B05.1.454.CMB.2.raw
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (270)..(271): a, c, t, g, unknown or other
  misc_feature (270)..(271): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcggnggtttcgtgtaggctatttagaaggngtcagtgtgaggtgcaatggtggagtctgggggaggcctgtccagccgggggggtccctgagctctcctgtgaagcctntgactcnctgnnatatgntgcgtggcgcgngcgcgaggaggngnggnggnggngcacanaanaaagagagaganacacactatgagctntgtgtagtggcgtactctactctcagagacgacgacaacaacacacacactactacacaataacgaaacaacgtaagaacgacgacggacggacgacgacgtagtagtacgttacgttgtagtagagagtacgtgttgtggtcggtacgggtacggacggtaccggtacggtacgtaccg

SEQ ID NO: 306676 - DNA, 540 bp, Homo sapiens
  misc_feature: GZ8MTXP02IEIO8.15.16.B05.1.454.CMB.2.raw
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgagggaaggggctggagtgggtggccacataacaaaaagntaggaagtgacacaacctatgtnactctgtgatggggccattcaccgtcnccagagacgacgaccaagaactcaactacatctgacaaatgaacaacctgagagcgagacaggctgtgtattactgtgtagagagattgttcgtggtcggttggggacccgtaggggaaccccttggtccctacccg

SEQ ID NO: 306677 - DNA, 557 bp, Homo sapiens
  misc_feature: GZ8MTXP02JPSC6.15.16.B05.1.454.CMB.2.raw
  modified_base (481)..(481): a, c, t, g, unknown or other
  misc_feature (481)..(481): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgcaggctccgaggggaggggctggaggtgggtggccaccataacaaaagataggaagtgacacaacctatgtgactctgtgagtgggccgattcaccgtctccagagacgacgccaaagactcactacatctagacaaatcgaaacaaccgtagagacgacccggaggacacggctgtnttattactgtgtagagtacgattgttcgtggtcggttacgggggaccgacgggtaaccctggggtaccctacccgg

SEQ ID NO: 306678 - DNA, 538 bp, Homo sapiens
  misc_feature: GZ8MTXP02JDALK.15.16.B05.1.454.CMB.2.raw
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttatggatgacttgggtccgccaggctccgaggggaaggggctggagtgggtggccacataacaaaagntggaagtgacacaacctatgngactctgtgagtgggccgattcaccgtctccagagacgacgaccaagaactcactacatctanacaanacaacacagagacgacgagacagntgtagtacttagtgtgagagacgtagtcgtgtggtcggtacggggaccgtacggtaccgtcggtaccgtccg

SEQ ID NO: 306679 - DNA, 541 bp, Homo sapiens
  misc_feature: GZ8MTXP02GFVVC.15.16.B05.1.454.CMB.2.raw
  modified_base (374)..(374): a, c, t, g, unknown or other
  misc_feature (374)..(374): n is a, c, g, or t
  modified_base (431)..(431): a, c, t, g, unknown or other
  misc_feature (431)..(431): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcacctgagcacttatggatgacttgggtccgccaggctccgaggggaaggggctggagtgggtggccaccataacaaaaagatggaagtgacacaacctatgtanactctgtgatgggcatcaccgtctccagagacgacgaccaagaactcactacatctnacaaatgaaaccaacctgaagacgccgaagacacggctgtgtattactgtgtagacgtagacgttgttctggcggttcggggaccgacgggaaccctggtaccgtacccg

SEQ ID NO: 306680 - DNA, 536 bp, Homo sapiens
  misc_feature: GZ8MTXP02HV42D.15.16.B05.1.454.CMB.2.raw
  modified_base (377)..(377): a, c, t, g, unknown or other
  misc_feature (377)..(377): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagctctcctgtgagcctctggattcaccttgagcacttatggatgacttggtccgccaggctccgagggaaggggctgggagtgggtggccaccataacaaaaagataggaagtgacacaacctatgtgactntgtgatgggccattcaccgtctccagagacgacgccaagaactcactacatctgacaaatgaacaacctagagagaccgaggacacggctgtgtattactgtgtgagagactgttcgtggcggttcggggaccgacgggtaccctgggtacctacccgg

SEQ ID NO: 306681 - DNA, 583 bp, Homo sapiens
  misc_feature: GZ8MTXP02G4MZN.15.16.B05.1.454.CMB.2.raw
  modified_base (352)..(352): a, c, t, g, unknown or other
  misc_feature (352)..(352): n is a, c, g, or t
  modified_base (532)..(532): a, c, t, g, unknown or other
  misc_feature (532)..(532): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagcctctggattcaccttgagcacttatggatgacttgggtccgcaggctccgaggggaaggggctgggagtgggtggccacataacaaaaagntaggaagtgaacacaaacctatgtagactctgtgagtggggccgattcaccgtctccgagagacgacgacaaagaactacaactacatactgacaaaatacgaaaacaaccgtagaacgagacccggaaggacctaacggctagtagtacttagtgtagtggaacgtagacgttggttcnggtcgggttacggggacccgaagggggtaacccctcgggtacctaccccgg

SEQ ID NO: 306682 - DNA, 519 bp, Homo sapiens
  misc_feature: GZ8MTXP02GVC7H.15.16.B05.1.454.CMB.2.raw
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgcaggctccgaggggagggctggagtgggtggccaccataacaaaagatggaagtgacacaacctatgtgactctgtgatgggcgattcaccgtctccagagacgacgaccaagactcactacatctgacaaatgaacaacctgagagccgaggacacggctgtgtattactgtgtgagagatgttcngcgttggggccagggaacctggtactaccg

SEQ ID NO: 306683 - DNA, 527 bp, Homo sapiens
  misc_feature: GZ8MTXP02FVXZA.15.16.B05.1.454.CMB.2.raw
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgccaggctccaggggaaggggctggagtgggngccaccatacaaaaagntggaagtgacacaacctangtgactctgtgatgggccgattcaccgtctccagagacgacgccaaagaactcactacatctgacaaatgaaacaacctgagagccgaggacacggctgtgtattactgtgtgagagatgttctggcgttgggggccagggaaccctgggtctacccg

SEQ ID NO: 306684 - DNA, 540 bp, Homo sapiens
  misc_feature: GZ8MTXP02HFSM0.15.16.B05.1.454.CMB.2.raw
  modified_base (492)..(492): a, c, t, g, unknown or other
  misc_feature (492)..(492): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggatcccgaggggaaggggctggagtgggtggccaccgataacgaaaaagataggaagtgacacaaacctatgtgactctgtagatgggccgattcaccgtctccagagacgacgaccaagaactcactacatctgacaaatgaaacacctagagacgaccgagacacggctgtagtattactggtntgagagactgttctgcggttcggggccaggggaaccctggtacacccg

SEQ ID NO: 306685 - DNA, 546 bp, Homo sapiens
  misc_feature: GZ8MTXP02FYSMD.15.16.B05.1.454.CMB.2.raw
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgccaggctccgaggggaagggctggagtgggtggccaccataacaaaagntggaagtgacanaacctatgtgactctgtgatggggccattcaccgtctccagagacgacgccaaagaactcactacatctgacaaatgaaacaacctgaagagccgaggacacggactgtagtacttacgtgtgtgagagtactgtttcnggccggttgggggacccaggggaacccctgggtacctacccgg

SEQ ID NO: 306686 - DNA, 610 bp, Homo sapiens
  misc_feature: GZ8MTXP02GBBHP.15.16.B05.1.454.CMB.2.raw
  modified_base (500)..(500): a, c, t, g, unknown or other
  misc_feature (500)..(500): n is a, c, g, or t
  modified_base (521)..(521): a, c, t, g, unknown or other
  misc_feature (521)..(521): n is a, c, g, or t
  modified_base (560)..(560): a, c, t, g, unknown or other
  misc_feature (560)..(560): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttatggatgacttggtccgtccgacggcgtccgtacgggaagggggacggtggtaggtagggtcggggccgaacccgaactaaacaaaaaagaaaagtaggtaaggtagtacgaacaaacctaactagtagtactacctgtgtagtggtcggacttcacccgtctcccagagacgacgaccagaaactcacacatactcgacaaatagaacaaaccngagagccgaggacacgacgtntaggtacttactagttggtagaggaacgtaatcgtttanggttcgggttcgggggacccgacggggaaacccgtcggtccgtaaccccg

SEQ ID NO: 306687 - DNA, 550 bp, Homo sapiens
  misc_feature: GZ8MTXP02GOXZ8.15.16.B05.1.454.CMB.2.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggaggcctcgtccaggccgggggggtccctgagactctcctgtgaagcctctggattcaccttgagcacttattggatgacttgggtccncaggctccgaggggaagggctggagtgggtcggccacataacaaaagntaggaagtgacacaacctatgtagactctggtgagtcggggaccgattccaccgtctaccagacgacgacgcaaagactcactacatcgnacaaatgaacaacngaagacgaccgaggacacgggtntgtatattagtgtgtagagagtcgttgtcgtggtcgggtacggggaccgacggtacccgtcggtacctaccg

SEQ ID NO: 306688 - DNA, 546 bp, Homo sapiens
  misc_feature: GZ8MTXP02FWNV8.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcactatggatgacttggtccgccaggctccgaggggaagggctggagtgggtggccaccgataacaaaaagataggaagtgacacaacctatcgtgactctgtgatgggcgattccaccgtccccagacgacgacgaccaaagactacaactacatctagaccaaatacgaacaacctaggagacgccgaggaccacggctgtgtattactgtgtgagagatgtctggaacggttgggaccgacggggtaaccctgggaccaccgtcc

SEQ ID NO: 306689 - DNA, 576 bp, Homo sapiens
  misc_feature: GZ8MTXP02FKEL1.15.16.B05.1.454.CMB.2.raw
  modified_base (153)..(153): a, c, t, g, unknown or other
  misc_feature (153)..(153): n is a, c, g, or t
  modified_base (261)..(261): a, c, t, g, unknown or other
  misc_feature (261)..(261): n is a, c, g, or t
  modified_base (468)..(468): a, c, t, g, unknown or other
  misc_feature (468)..(468): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgnggtttcgtgtaggctatttagaaggtgtccagtgtgaggtgcaactggtggagtctgggggaggcctcgtccagccggggggtccctgagactctcctgtgaagcctnggattcacttgagcacttatgatgtacgttgggtccgccgacggcgtccgaggggaggggcggtgggtaggtggggtgggccgaccgaactaaacgaaaaagaagtaggaacgtagacaacaacctatagtagtactctgtgtagtgggcgacgtctaccgtcctaccgacgagacgacgaccgaacgaactacactacactactanacaaatagaaacaacctagagacgacgacggacgacgcgtgtgtacgttagtgtgtgagagtagtgttcgtgtcggtcgggcggacggtaccggtacggtacgtaccg

SEQ ID NO: 306690 - DNA, 542 bp, Homo sapiens
  misc_feature: GZ8MTXP02IG49G.15.16.B05.1.454.CMB.2.raw
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (468)..(468): a, c, t, g, unknown or other
  misc_feature (468)..(468): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagtaaggtgtccagtgtgaggtgcaactggtggagtctgggggaggcctcgtccaggcccgggggggtccctgagactctcctgtgaagcctctggattcaccttgagcacttatggatgacttgggtcccgccaggctccgaggggaaggggctggagtgggtggccacataacaaaagntggaagtgacacaacctatgngactctgtgatgggggccattcaccgtcnccagagacgacgaccaagaactcaactacatctgacaaatgaaacactagagagccgaggacnggctgtgtattactgtgtgagagattgttcgtggtcggttgggggaccacgggggtaccccttggccctacccg

SEQ ID NO: 306691 - DNA, 544 bp, Homo sapiens
  misc_feature: GZ8MTXP02F8KIH.15.16.B05.1.454.CMB.2.raw
  modified_base (507)..(507): a, c, t, g, unknown or other
  misc_feature (507)..(507): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaaggggctggagtggggtggccaccataacaaaaagataggaagtgacacaacctatgtgactctgtgagtgggcattcaccgtctccagagacgacgccaagaactcactacatctgacaaatgaaaccaacctagaacgacgaccgaaggacacggctgtagtactacgtgtgtgagagatgttcnggtcggttcggggccaggggaccctcggtactacccg

SEQ ID NO: 306692 - DNA, 547 bp, Homo sapiens
  misc_feature: GZ8MTXP02JE9QI.15.16.B05.1.454.CMB.2.raw
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (497)..(497): a, c, t, g, unknown or other
  misc_feature (497)..(497): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgccaggatccgaggggaagggctggagtgggtggccacatacaaaagntggaatgacacaacctangtgactctagtgatgggccgattcaccgtctccagagacgacgcaagaactcactacatctgacaaatgaaacaacctgagagacgaggacacgggctgtgtattacgtgtgtgaagacgattgttacnggtcggtttacggggaccggacgggtaaccccttggggtaccctacccgg

SEQ ID NO: 306693 - DNA, 554 bp, Homo sapiens
  misc_feature: GZ8MTXP02HMW1T.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgagcctctggattcaccttgagcacttattggatgacttgggtcccgccaggctccgaggggaaggggctggagtgggtggccaccataacaaaagatggaagtgacacaacctatgtgactctgtgagtggggccattccaccgtctccagacgacgacgaccaagaactcactacatctgacaaatgaacaacctgaagacgccgaggaccacggactgtagtattacgtgtgtagagagattgttcgtggtcggttcgggggacccgaacgggtacccgtgggtacctaccccg

SEQ ID NO: 306694 - DNA, 563 bp, Homo sapiens
  misc_feature: GZ8MTXP02GSHDM.15.16.B05.1.454.CMB.2.raw
  modified_base (301)..(301): a, c, t, g, unknown or other
  misc_feature (301)..(301): n is a, c, g, or t
  modified_base (352)..(352): a, c, t, g, unknown or other
  misc_feature (352)..(352): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcctgtgctattttagaaggtgtccagtgtgaggtgcaactggtggagtctgggggaggcctcgtccaggccgggggggtccctgagactctcctgtgaagcctctggattcaccttgagcacttattggatgacttgggtccncaggctccgaggggaaggggctggagtgggtggccaccgataacaaaaagntaggaagtgacacaacctatgtgactctgtgatggggcattccaccgtctccagacgacgacgaccaagaactcaactacatctgacaaatcgaaacaaccgngaagagaccgaggacaccggntgtagttattagtgtgtagagtagtagttcggttcgtcggtcgggttacggggaccgtaccggggtacccgtcggtacccgtacccg

SEQ ID NO: 306695 - DNA, 548 bp, Homo sapiens
  misc_feature: GZ8MTXP02FT9KQ.15.16.B05.1.454.CMB.2.raw
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtcagtgtgaggtgcaactggtggagtctgggggaggcctcgtccaggccggggggtccctgagactctcctgtgaagcctntggattcaccttgagcacttatggatgacttggccgcaggctccgaggaggggctggagtgggngccacataacaaaaagngtaggacgtagacactaactatgtagactcgngtagagtcgggctattccaccgtctacgacgacgacgacgacaacgaacacactacactacanacaatanaacaacgagagacgacgacgacgacgacgtgtagtacgttagtgtagtagagagtagtgttgtggtcggtcgggtacggaccggtaccggtacggtacgtaccg

SEQ ID NO: 306696 - DNA, 586 bp, Homo sapiens
  misc_feature: GZ8MTXP02GK7Q1.15.16.B05.1.454.CMB.2.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttggttttccttgttgctattttagaaggtgtccagtgtgaggtgcaactggtggagtcgtgggggtggcctcgtccaggccgggggggtccctgagactctcctgtgagcctctggattcaccttgagcacttatggatgacttgggtccgccaggctccgaggggaaggggctggagtgggtgccacataacaaaagntaggaagtgacacaacctatgtgactctgtgatgggcatcaccgtctccagagacgacgccaaagactacactacatctgaccaaaatgaaacctaaccgtgaacgacggaccggaacggaaccacgggtctaggtagttaacgttacgttggtagtggaagtacgtaattggtttcctgggtccgtttacggggggccctaaacgggggtaaccctcggggtacctaaccccgg

SEQ ID NO: 306697 - DNA, 561 bp, Homo sapiens
  misc_feature: GZ8MTXP02JMMMB.15.16.B05.1.454.CMB.2.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (440)..(440): a, c, t, g, unknown or other
  misc_feature (440)..(440): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttatggatgacttgggtccgccaggctccgaggggaagggctggagtgggtcggccaccataacgaaaaagngtaggaagtagacacaacctatgtanactctgtgagtgggcattccaccgtctcccagacgacgacgaccaagaactcactacntctgacaaatgaacactgagagaccgagacacggctgtagtacttagtggtgtaggagacgtagttgttcgtggtcgggttacgggggccctaacggggaacccgtcggtacctaccccgg

SEQ ID NO: 306698 - DNA, 548 bp, Homo sapiens
  misc_feature: GZ8MTXP02HUA0X.15.16.B05.1.454.CMB.2.raw
  modified_base (163)..(163): a, c, t, g, unknown or other
  misc_feature (163)..(163): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (530)..(530): a, c, t, g, unknown or other
  misc_feature (530)..(530): n is a, c, g, or t
  modified_base (537)..(537): a, c, t, g, unknown or other
  misc_feature (537)..(537): n is a, c, g, or t
  modified_base (539)..(548): a, c, t, g, unknown or other
  misc_feature (539)..(548): n is a, c, g, or t
tcagtctacgtagccacgaccggtgctcgatttagagctcacgtattgggtccctgagactctcctgtgaagcctctggattcaccttgagcacttattggatgacttgggtccgccaggctccagggaagggctggagtgggtggccaccataacaaaaagntggaagtgacacaacctatgtgaactctgtgatgggccgattcaccgtctccagagacgacgccaaagaactcactacatctgcaaatgaaacaacctgagagccgaggacacgggctgtgtattactgtgtgagagatgttctgcggttggggccagggaccctggtcaccgtctcctcacgcctccaccaagggcccatcggtccttcccccnggccncccctgcctccgaggactcaccctcgagcgcacgacggccggcccgtggggctcggaccgttggtaccgaaacgggtaccttacctttcccggacctttaacggagtaaccgtggacggccggggcgtcgggacgaaacgggccganactaggncnnnnnnnnnn

SEQ ID NO: 306699 - DNA, 604 bp, Homo sapiens
  misc_feature: GZ8MTXP02F8A51.15.16.B05.1.454.CMB.2.raw
  modified_base (305)..(305): a, c, t, g, unknown or other
  misc_feature (305)..(305): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(604): a, c, t, g, unknown or other
  misc_feature (594)..(604): n is a, c, g, or t
tcagtctacgtagccacgaccggtgctcgatttagagctcacgtattgggtccctgagactctcctgtgaagcctctggattcaccttgagcacttattggatgacttgggtccgccaggctccagggaaggggctggagtgggtggccaccataacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttcnggcggttggggccaggggacccctgggtccaccgtctcctcaccgcccctaccaaccgaacggggccccctagttcccgggttcccttccccccgtgggccccgtccccctgccctccgagggacgcccacccgtccgagacgccacgacggccgggcccgtggggcctcggcccgttcgggtaccgaaacgggtaccttacccgtttacccggaccgttaaccggtacggtaacgtgggaacgggccgggggacgtcggggaccgaaggggccgacgaagtagngncnnnnnnnnnnn

SEQ ID NO: 306700 - DNA, 535 bp, Homo sapiens
  misc_feature: GZ8MTXP02FLNIF.15.16.B05.1.454.CMB.2.raw
  modified_base (355)..(355): a, c, t, g, unknown or other
  misc_feature (355)..(355): n is a, c, g, or t
  modified_base (526)..(526): a, c, t, g, unknown or other
  misc_feature (526)..(526): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggatccgaggggaaggggctggagtgggtggccaccataacaaaaagntggaagtgacacaacctatgtgactctgtgatgggccgattcaccgtctccagagacgacgccaaagactcactacatctgacaaatgaaacaaccgtgaagacgaccggaaggacacgggctggtgtattactgtagtgagagatgtctgcgttggggccagggtacccnggcctaccg

SEQ ID NO: 306701 - DNA, 531 bp, Homo sapiens
  misc_feature: GZ8MTXP02GQQ3D.15.16.B05.1.454.CMB.2.raw
  modified_base (493)..(493): a, c, t, g, unknown or other
  misc_feature (493)..(493): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgcaggctccgagggaaggggctggagtgggtgaccaccataacaaaaagatggaagtgacacaacctatgtgactctgtgatgggccattccaccgtctccagagacgacgcaagaactcactacatctagacaaatgaaacaacctgaagagccgaggacacggctgtgtacttatgtgtgagagatgttnggtcggttggggcctacgggaccctcgggtactacccg

SEQ ID NO: 306702 - DNA, 578 bp, Homo sapiens
  misc_feature: GZ8MTXP02IZKBP.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtcctgagactctcctgtgaagcctctggattcaccttgagcacttatggatgacttgggtccgccgaggctccgaggggagggctggagtgggtgccacataacaaaagatggagtgacacactatgtagactctagtgagtcggggcctattccaccgtctccgagacgacgacgaccaagaacctcacacatactagacaaatcgaaaccactaggaacgacgaccggaggacgacggtcgtagttagtatttacgtggtcgtagtaggtacgtacgttgttcgtgggtccgggttacgggggaccgacggggtaaccctggggtacccttaccccgg

SEQ ID NO: 306703 - DNA, 551 bp, Homo sapiens
  misc_feature: GZ8MTXP02IAKZZ.15.16.B05.1.454.CMB.2.raw
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (456)..(456): a, c, t, g, unknown or other
  misc_feature (456)..(456): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagcacttattggatgacttgggtcccgccaggctccgaggggaaggggctggagtgggtggccaccataacaaaagntaggaagtgacacaacctntgtnactctgtgatggggcatcaccgtnccagacgacgacgcaaagactcaactacatctagacaaaatgaaacctaaccgngagacgccgagaccgacgactgtcttattacgtgtgtgagtcgattcgttcnggtcggttacggggcctaacggggaccctcgggtacctacccg

SEQ ID NO: 306704 - DNA, 560 bp, Homo sapiens
  misc_feature: GZ8MTXP02GCGBM.15.16.B05.1.454.CMB.2.raw
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (524)..(524): a, c, t, g, unknown or other
  misc_feature (524)..(524): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttatggatgacttgggtccncaggctcgagggaggggctggagtgggtggccacataacaaaaagntaggaagtgacaacaacctatgtagactctggtgagtgggaccgtattccaccgtctccagacgacgacgaccaaagaactcactaacatactagacaaaatcgaaaccaaccgtagaacgacgaccggaagaccgacggctagtgtattacgtgtgtagagagactgttcgngtcgggtcgggaccgacgggaccgtcggtacctccg

SEQ ID NO: 306705 - DNA, 552 bp, Homo sapiens
  misc_feature: GZ8MTXP02IA0FD.15.16.B05.1.454.CMB.2.raw
  modified_base (353)..(353): a, c, t, g, unknown or other
  misc_feature (353)..(353): n is a, c, g, or t
  modified_base (404)..(404): a, c, t, g, unknown or other
  misc_feature (404)..(404): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcacttgagcacttattggatgacttgggtcccgcaggatccgaggggaaggggctggagtgggtggccacataaacaaaagntaggaagtgacacaactatgtagactctgtgatggggccattccaccgtcnccagagacgacgaccaaagactcaactacatctagacaaatcgaaacaaccgtgaacgacgccgaaggactacgggctggtagtattactgtgtagagagacttgtctggtcggttcggggaccgtaggggacccctggtaccacccg

SEQ ID NO: 306706 - DNA, 539 bp, Homo sapiens
  misc_feature: GZ8MTXP02HAXC7.15.16.B05.1.454.CMB.2.raw
  modified_base (370)..(370): a, c, t, g, unknown or other
  misc_feature (370)..(370): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggctccgaggggaagggctggagtgggtggccacatacaaaaagtggaagtgacacaacctangtgactctgtgatggggccattccaccgtctcccagagacgacgccaagactcactacatctgacaaatgaaacaacctgacgagccgaggacgacggctgtgttacttacgtgtgtgagagatgttcgtggcggttcggggccgtagggacccgtgggtacctacccg

SEQ ID NO: 306707 - DNA, 537 bp, Homo sapiens
  misc_feature: GZ8MTXP02GGLA7.15.16.B05.1.454.CMB.2.raw
  modified_base (262)..(262): a, c, t, g, unknown or other
  misc_feature (262)..(262): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcctgtaggctatttagaaggtgtccagtgtgaggtgcaactggtggagtctgggggaggcctcgtccagccggggggtccctgagactctcctgtgaagcctcnggattcaccttgagcacttattggatgacttgggtccgccaggctccgaggggagggctggagtggtggccacataacaaaagntggaactgacacaactatgtagactntgtgagtcgggactatccgaccgtcacgagagacgacgacaaacgacacactacatcgananaanagaacaacagacgacgacgacgacgacgacgtgtagtactagtgtgtagtagagtagtgtcgtgtcggtacgggtacggacggaccgtacgtacgtaccg

SEQ ID NO: 306708 - DNA, 531 bp, Homo sapiens
  misc_feature: GZ8MTXP02G1O5O.15.16.B05.1.454.CMB.2.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtcccgcaggctccgaggggaaggggctggaggtgggtggccaccgataacaaaaagntaggaagtgacacaacctatgtgactctgtgatgggccgattccaccgtctccagagacgacgccaagactcactacatctgacaaatgaacaacctgaagagcgaggacacggctgtgtatacgtgtgtgagagatgtctggcggttcggggaccagggaccctggtactacccg

SEQ ID NO: 306709 - DNA, 606 bp, Homo sapiens
  misc_feature: GZ8MTXP02F148H.15.16.B05.1.454.CMB.2.raw
  modified_base (487)..(487): a, c, t, g, unknown or other
  misc_feature (487)..(487): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgtctattttagtaaggtgtccagtgtgaggtgcaactggtggagtcgtgggggaggcctcgtccgaggccggggggtcccgtgagactctcctgtgagcctctggattcaccttgagctacttatggatgacgttgggtccgccaggctccgaggggaagggcgtggaggtggggtcgggcccaccaataaacgaaaaagagtggaagtagacaacaaacctagtagtagacctctggtagagtcgggcgtattccacccgtctcccaggacgacgaccgaccaagaactcactaccatcctagacaaatgaaaccaaaccnggaagacgggaccgaaggaaacgcggtctagtagttattacgtggtgtagaacgtagattcggttactgggtccggttagggggccccgaaaggggtaccccgtcggttacctaccccg

SEQ ID NO: 306710 - DNA, 659 bp, Homo sapiens
  misc_feature: GZ8MTXP02IO83O.15.16.B05.1.454.CMB.2.raw
  modified_base (69)..(69): a, c, t, g, unknown or other
  misc_feature (69)..(69): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagtctacgtagccacgaccggtgctcgatttagagctcacgtatggggtttggggggagtcagactnagtcaggacacagcatggacatgagggtccccgctcagctccgtggggctcctgctgctctggctccccaggtgccaaatgtgacatccagatgacccagtctccgtccaccctgtctgcatctgtcgagacagagtccaccatccacttcggccggccacgacagagttattaactaagttggttcggcgttggtttcacgcgaaacgaaaacgccccggaaacgtaaccccgaaaacgtcctagactctctcggccgcctctactttcggnaaaaattgggggttacccccncgtcgtacggacgccgcggtcgagtcggtacnggtacgggacaagtacgtacgagtctcnccactccacgacacgccgtcgcgacgaccgtcgacgtactttacgtactaaactttaaccttacctgaaccncncgtaacgtacgtacttaaacttaaacgtttaaacgttacgttaacggttaacgggtacgggtaaccgggtaacggtaacgggtaacgggtcgaaacgttacgtaaaacggtaaacgtacgtaacggtaccgtacgtacgtaccgacgttaccgttacgtacg

SEQ ID NO: 306711 - DNA, 545 bp, Homo sapiens
  misc_feature: GZ8MTXP02I2Y1O.15.16.B05.1.454.CMB.2.raw
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagcctctggattcaccttgagcacttatggatgacttgggtccgcaggctccgaggggaaggggctggagtgggtggccaccataacaaaaagntaggaagtgacacaacctangtgactctgngatgggccgattccaccgtctccagagacgacgcaaagaactcaactacatctgacaaatgaaacacctagacgacgacgaggaacacggctgtgtattacgtgtgtagagagagtgttcgtgtcggttgggggcctagggggaaccctcggggtaccacccg

SEQ ID NO: 306712 - DNA, 552 bp, Homo sapiens
  misc_feature: GZ8MTXP02GH0JX.15.16.B05.1.454.CMB.2.raw
  modified_base (373)..(373): a, c, t, g, unknown or other
  misc_feature (373)..(373): n is a, c, g, or t
  modified_base (510)..(510): a, c, t, g, unknown or other
  misc_feature (510)..(510): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgccaggctccgaggggaggggctggaggtgggtggccaccataacaaaagatggaagtgacacaacctatgngactctgtgatggggcattcaccgtctccagagacgacgaccaagaactcactacatctgacaaatgaaacaacctgaacgacgacccggaggaaccacggctgtagtacttacgtgtgtaggagacgattggttcnggtcggttcgggggaccgacgggtaccctggggtcctacccg

SEQ ID NO: 306713 - DNA, 532 bp, Homo sapiens
  misc_feature: GZ8MTXP02JJEO6.15.16.B05.1.454.CMB.2.raw
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (494)..(494): a, c, t, g, unknown or other
  misc_feature (494)..(494): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccnccaggctccgaggggaggggctggagtgggtgccacatacaaaagntgaagtgacacaacctangtagactctgtgatggggccattcaccgtctccagagacgacgacaagaactcactacatctgacaaatcgaaacacctgaagagaccgaggacacggctgtgtattactgtgtagagacgatgttcnggtcggttacgggggccaggggaccctgggtctacccg

SEQ ID NO: 306714 - DNA, 570 bp, Homo sapiens
  misc_feature: GZ8MTXP02IHVCO.15.16.B05.1.454.CMB.2.raw
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccgaggccgggggggtccctgagactctcctgtgaagcctctggattcaccttgagcacttatggatgacttgggtcccgcaggctccgaggggagggctggagtgggngccacataacaaaagatggaagtgacacaactngtgactctgtgatggggccattcaccgtntccagagacgacgaccaaagaactcaactacatctgaaccaaaatcgaaacaacctagaacgacgaccggaggacacgggtctagtagtacttagtggtaggtagagtagtagttcggttcgtggtcggggttacggggaccggtaaccgggtacccgttcggtacccgtcccg

SEQ ID NO: 306715 - DNA, 601 bp, Homo sapiens
  misc_feature: GZ8MTXP02HLQQJ.15.16.B05.1.454.CMB.2.raw
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgagcacttattggatgacgttgggtcccgccgaggctaccgagggggaacggggcgtgggaggtggggtcggcccacgaataaacaaaaagngtaggaagtgacacaactatgngactntgtgagtggggccgtattccgacccgtctacccgagacgacgaccgaccgaaacgaactcaactacatctagacaaatagaaaccaaccgtgagacggaccgaggacacggctagtgttatacgtgtaggtggagtagtacgttggttcgtcggtcgggttacgggggacccgtacggggtaacccctcgggtacctaccccgg

SEQ ID NO: 306716 - DNA, 545 bp, Homo sapiens
  misc_feature: GZ8MTXP02GS0MD.15.16.B05.1.454.CMB.2.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaagtgtccagtgtgaggtgcaactggtggagtcgtgggggaggcctcgtccaggccggggggtccctgagactctcctgtgaagcctctggattcaccttgagcacttatggatgacttgggtccncaggctcgagggagggctggagtgggtgccacataaacaaaagntaggaagtgacacaacctatganactntgtgatgggcctatcaccgtntccagagacgacgacaaagactacactacatctagaccaaatgaaacacctagaacgacgcccgaaggacacgggctagtcgtattacgtgtacggtagacgtagattggttctggcggttacggggccagggaccctggtaccctaccgg

SEQ ID NO: 306717 - DNA, 562 bp, Homo sapiens
  misc_feature: GZ8MTXP02FQ607.15.16.B05.1.454.CMB.2.raw
  modified_base (353)..(353): a, c, t, g, unknown or other
  misc_feature (353)..(353): n is a, c, g, or t
  modified_base (518)..(518): a, c, t, g, unknown or other
  misc_feature (518)..(518): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttatggatgacttgggtccgccaggctccgaggggaaggggctggagtggggtggccacataacaaaagntaggaacgtgacacaacctatgtagactctgtgatggggccgattcacccgtctcccagacgacgacgaccaagaacctcactacatctagaccaaatcgaaacaaccgtagagacgacccggaggaccacggctgtagtattactgtagtggagagtatgttgnggtcggttcggggaccgacggggtaacccgtggtaccctacccg

SEQ ID NO: 306718 - DNA, 600 bp, Homo sapiens
  misc_feature: GZ8MTXP02JBWSG.15.16.B05.1.454.CMB.2.raw
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
  modified_base (452)..(452): a, c, t, g, unknown or other
  misc_feature (452)..(452): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgagctctggattcacctgagcacttatggatgacttggtccncgaggctccgaggggagggctggagtgggtcggccacataaacaaaagntaggaacgtgacaacaacctatgtacgactctgtagacgtggggaccctattccgaccgtctacccgagacgacgacgacaagaactcactacatacagttaaancgaaacaccgtgaacgacgaccgtaggaccgaacgggcttagtagtaactttacgtggttgtacggataacggtagttcgttcggtggtaaccgggttcgggggaccgtaaacgggggtaccccttcgggtacccacccggtttcccg

SEQ ID NO: 306719 - DNA, 590 bp, Homo sapiens
  misc_feature: GZ8MTXP02J226A.15.16.B05.1.454.CMB.2.raw
  modified_base (322)..(322): a, c, t, g, unknown or other
  misc_feature (322)..(322): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (446)..(446): a, c, t, g, unknown or other
  misc_feature (446)..(446): n is a, c, g, or t
  modified_base (507)..(507): a, c, t, g, unknown or other
  misc_feature (507)..(507): n is a, c, g, or t
  modified_base (521)..(521): a, c, t, g, unknown or other
  misc_feature (521)..(521): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggacgccgtcggtccgacgggcccggggggtcctgacgtactctcgtgtgacgtcctcgtggtattccaccttgacgctacttagtggatgacgttcgggccncgaggcctcggaggggaggctggagtgggcgccacataacaaaagntaggaagtcgacaacaactntgtagactgtagtgagtcgggctattccacccgttcaccagacgaccgacgactaaanactcaactacatccagacaaagtcgaaaaccacgagacgacggaccggaggacgacggttntagtattacgtagngtaggtacgagtacgtcgttcggtcgtcgggtcgggtacgggaccgtaccggtacccgtcggacctccg

SEQ ID NO: 306720 - DNA, 546 bp, Homo sapiens
  misc_feature: GZ8MTXP02H2GVT.15.16.B05.1.454.CMB.2.raw
  modified_base (403)..(403): a, c, t, g, unknown or other
  misc_feature (403)..(403): n is a, c, g, or t
  modified_base (475)..(475): a, c, t, g, unknown or other
  misc_feature (475)..(475): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctgatcactgagcacttatggatgacttgggtccgccaggctccgaggggaaggggctgggagtgggtggccacataaacaaaagataggaagtgaacacaacctatgtgactctgtgatcgggccgattccaccgtcnccagagacgacgaccaaagaactcaactacatctagacaaatagaacaacctgagacgacgaggacacggcngttcgtatacgtgtgtgagacgtattgttcgtggtcggttcggggcccgaggggtaccctggtaccacccg

SEQ ID NO: 306721 - DNA, 568 bp, Homo sapiens
  misc_feature: GZ8MTXP02IXN9V.15.16.B05.1.454.CMB.2.raw
  modified_base (356)..(356): a, c, t, g, unknown or other
  misc_feature (356)..(356): n is a, c, g, or t
  modified_base (525)..(525): a, c, t, g, unknown or other
  misc_feature (525)..(525): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccgggggggtccctgagactctcctgtgaagcctctggattcaccttgagcacttatggatgacttggggtcccgcaggcctccgaggggaagggctggagtgggtggccaccataacaaaagntggaagtgacacaacctatgtgactctgtcgatggggaccgtattccacccgtctacccagacgaccgacgacccaagtaacctcactacatctagactaaatgaaaccacgtagacgacgccggaaggaccacggtctgtagtacttagtgtgtgagagtactgttcnggccggttgggggaccctaacggggtaccctcggtcctacccg

SEQ ID NO: 306722 - DNA, 540 bp, Homo sapiens
  misc_feature: GZ8MTXP02FUR3M.15.16.B05.1.454.CMB.2.raw
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttggggtccnccaggctccgaggggaaggggctggagtgggtcggccaccatacaaaaagntggaagtgacacaacctatgtgactctgtgatgggcccgtattccaccgtctcccagacgacgacgaccaagaactcactacatctgacaaatgaaacaacctgacgacgccgaggacacggctgtgtattacgtgtgtgagagatgttacnggcgttcggggaccagggaccctggcctaccg

SEQ ID NO: 306723 - DNA, 553 bp, Homo sapiens
  misc_feature: GZ8MTXP02JYHKB.15.16.B05.1.454.CMB.2.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacgttgggtcccgcaggctccgaggggagggctggagtggtgaccacataacaaaaagntaggaagtgacacaacctatgtgactctgtgagtggggccgattcgacccgtctccagacgacgacgacaaacgactacaactacactactgacaaagtagaaacaacctgaacgacgaccgaaggacacggctgtatattacgtgtagtagagagtacttgtgtggtcggttacgggccgacgggaccctggacctaccg

SEQ ID NO: 306724 - DNA, 594 bp, Homo sapiens
  misc_feature: GZ8MTXP02JUVV2.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgagcacttatggatgacgttgggtcccgcgaggcctccgaggggaggggctgggaggtgggtggcccaccaataaacgaaaaagagtaggaacgtagacaaccaaacctagtgtagactcgtggtcgagtcggggccattccaccgtctaccagacgacgaccgaccaagaactcacacatctgacaaatacgaaacacgtagaacgacggacgaaggacctacggctgtacgttattacgtggtagtaggagtacgtagttcgttcgtggtcgggttcggggaccgtacgggtacccggtcggtacccgtacccg

SEQ ID NO: 306725 - DNA, 543 bp, Homo sapiens
  misc_feature: GZ8MTXP02FQ2N5.15.16.B05.1.454.CMB.2.raw
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttatggatgacttgggtccnccaggctccgaggggaaggggctggagtgggtggccaccatacaaaaagntggaagtgacacaacctatgtgactctgtgatggggaccgattcaccgtctcccagacgacgacgccaaagaactcactacatctgacaaatgaacaactgacgagccgaggacacggctgtagtattacgngtgtgagagtactgttcgngtcggttggggacccgaggggtaaccctgggtacctacccg

SEQ ID NO: 306726 - DNA, 559 bp, Homo sapiens
  misc_feature: GZ8MTXP02F2ME6.15.16.B05.1.454.CMB.2.raw
  modified_base (350)..(350): a, c, t, g, unknown or other
  misc_feature (350)..(350): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagcctctggattcaccttgagcacttatggatgacttgggtccgcaggctccgaggggaagggctggagtgggtgccaccataacaaaaagntggaagtgacacaacctatgtagactctgtgatggggcctattcaccgtctaccagacgacgacgaccaaagaacctacactacatctagacaaatgaaacaacctgaacgaggccgaaggacacggctagtgtacttactaggtgtaggagacgtatgttcgnggtcggttcggggaccgacggggtaacccgtgggtacctacccgg

SEQ ID NO: 306727 - DNA, 533 bp, Homo sapiens
  misc_feature: GZ8MTXP02FNAL8.15.16.B05.1.454.CMB.2.raw
  modified_base (353)..(353): a, c, t, g, unknown or other
  misc_feature (353)..(353): n is a, c, g, or t
  modified_base (434)..(434): a, c, t, g, unknown or other
  misc_feature (434)..(434): n is a, c, g, or t
  modified_base (493)..(493): a, c, t, g, unknown or other
  misc_feature (493)..(493): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgaggggaaggggctggaggtgggtggccacataacaaaaagntggaagtgacacaacctatgtgactctgtgatgggcgattcaccgtctccagacgacgacgccaaagaactcactacatcnacaaatgaacaacctgagagccgaggacacgctgtgtatactgtgtgagtagatgttcnggtcggttcggggaccacgggaacccgtcggtactacccg

SEQ ID NO: 306728 - DNA, 533 bp, Homo sapiens
  misc_feature: GZ8MTXP02HHIRF.15.16.B05.1.454.CMB.2.raw
  modified_base (351)..(351): a, c, t, g, unknown or other
  misc_feature (351)..(351): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
  modified_base (485)..(485): a, c, t, g, unknown or other
  misc_feature (485)..(485): n is a, c, g, or t
  modified_base (502)..(502): a, c, t, g, unknown or other
  misc_feature (502)..(502): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgcaggctccgaggggaagggctggaggtgggtggccacataacaaaaagntaggaagtgacacaactatgtgactctgtgagtgggccattccaccgtctcccgagacgacgaccgaccaaagaactcactacatcngacaaatgaacacctgaganccgaggacacgggctgtctattactgngtgaagtcgattgttcngcggttcgggccaggggacctcgggctaccg

SEQ ID NO: 306729 - DNA, 609 bp, Homo sapiens
  misc_feature: GZ8MTXP02HKR1M.15.16.B05.1.454.CMB.2.raw
  modified_base (372)..(372): a, c, t, g, unknown or other
  misc_feature (372)..(372): n is a, c, g, or t
  modified_base (553)..(553): a, c, t, g, unknown or other
  misc_feature (553)..(553): n is a, c, g, or t
  modified_base (574)..(574): a, c, t, g, unknown or other
  misc_feature (574)..(574): n is a, c, g, or t
tcagtctacgtagccacgaccggtgctcgatttagagctcacgtattgggtttgaggtctcagagaggagccttagccctggactccaaggccctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctcgtggattcaccttgagctacttattggatgacgttcgggtccgccgaggcctccggaaggggacggggctgggaggtgggtcggacccaacaataaacaaaaagngtaggaacgtgaccaacgaacctagtgtagacctgtgtgagtcggggccaattcccacccgttctaccccgaagacgaaccgaacccgaccaaaagacctacaaactaacagtctagaacctaaatacaaaaccctaacgagaacgacgacccgaaggacgacggctaggtactacttagngtgtagagacgtatcgttggnggtcggtcgggacgaccggtaccgtcggtacaccg

SEQ ID NO: 306730 - DNA, 564 bp, Homo sapiens
  misc_feature: GZ8MTXP02H6VBR.15.16.B05.1.454.CMB.2.raw
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagactctcctgtgaagcctctggattcaccttgagcacttattggatgacttggggtcccgccgaggctccgaggggaaggggctggaggtgggtggccaccataacaaaaagntaggaagtgacacaaacctatgtnactctgtgagtgggccattcccacccgtctccagacgaccgacgaccaaagaacctcaactacatctagacaaatgaaacactgagacgcgagacacggctgtgtacttcgtgtgtgagtgagttgttcgtggcgggttacggggaccgtacggggtaccccgttggtacccgtacccg

SEQ ID NO: 306731 - DNA, 541 bp, Homo sapiens
  misc_feature: GZ8MTXP02G63G3.15.16.B05.1.454.CMB.2.raw
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
  modified_base (477)..(477): a, c, t, g, unknown or other
  misc_feature (477)..(477): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgaagcctctggattcaacttgagcacttattggatgacttgggtccncaggctcgagggagggctggagtggngccacataacaaaagntggaagtgacacaactangtagactctagtgagtggggccattccaccgtcncccagagacacgcaaagaactcaactacattcngacaaatgaaacaccagagagaccgaggacacgctgtgtactactgngtagagacgattgttaccgtggtcggttcggggaccaagggtacccgtcgggttacaaccccgg

SEQ ID NO: 306732 - DNA, 570 bp, Homo sapiens
  misc_feature: GZ8MTXP02G5IJY.15.16.B05.1.454.CMB.2.raw
  modified_base (557)..(570): a, c, t, g, unknown or other
  misc_feature (557)..(570): n is a, c, g, or t
tcagtctacgtagccacgaccggtgctcgatttagagctcacgtattgggtccctgagactctcctgtgaagcctctggattcaccttgagcacttattggatgacttgggtccgccaggctccgaggggaaggggctggagtgggtggccaccataacaaaaagatggaagtgacacaacctatgtgaactctgtgatgggccgattcaccgtctccagagacgacgccaagaactcactacatctgacaaatgaacaactgagagccgaggacacggctgtgtattactgtgtgagagtatgttctggcggttggggccaggggtaccctggtccaccgtctcctcaccgccctaccgaaccgaacgggcccctagttcccgggttcccttcccccgtgggcccgtccccctggccctccgaagggacgcccgacccgtccggaagacgccgacgacggcccggcccgtgggccgtcgccgtggtcgacggggtacctaccgttccgacgtacgtacgacgtggacggcgggcgtggacgaacgggcgacagagnnnnnnnnnnnnnn

SEQ ID NO: 306733 - DNA, 565 bp, Homo sapiens
  misc_feature: GZ8MTXP02GBAO5.15.16.B05.1.454.CMB.2.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
  modified_base (432)..(432): a, c, t, g, unknown or other
  misc_feature (432)..(432): n is a, c, g, or t
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccggggggtcctgagactctcctgtgagcctctggattcaccttgagcacttatggatgacttgggtccncaggctccgagggagggctggagtgggtgccacatacaaaagntaggaagtgacacaacctatgtagactctggtgagtcggggcctattccaccgtctaccagacgacgacgccaaagactcactacntcctagacaatgaaaccaaccgtgaacgacgacgaggacacggctgtgtacttacgngtagtgagacgtattggttacgtggtcgggttcgggggacccgtacggggtaaccccgtggtacccgtaaccccgg

SEQ ID NO: 306734 - DNA, 599 bp, Homo sapiens
  misc_feature: GZ8MTXP02GE0TT.15.16.B05.1.454.CMB.2.raw
  modified_base (546)..(546): a, c, t, g, unknown or other
  misc_feature (546)..(546): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagctacttattggatgacttgggtcccgccgaggcctccgaggggaaggggcgtgggaggtggggtcggacccaccgaataaacaaaaagagtaggaagtgacacaacctatgtgactcgtgtgagtcgggcctattccaccgtctaccgagacgacgacacaaacgaactcaacacatcgagacaaatcgaaacaaccgtgaacggacgaccggaggaccgacggacgttgtagttacttcgttggtgtagaggagtagttcgttgngggttcgggttacgggggaccgtacggggtaaccctcggggtaccctacccgg

SEQ ID NO: 306735 - DNA, 524 bp, Homo sapiens
  misc_feature: GZ8MTXP02I32ZP.15.16.B05.1.454.CMB.2.raw
  modified_base (351)..(351): a, c, t, g, unknown or other
  misc_feature (351)..(351): n is a, c, g, or t
  modified_base (425)..(425): a, c, t, g, unknown or other
  misc_feature (425)..(425): n is a, c, g, or t
  modified_base (476)..(476): a, c, t, g, unknown or other
  misc_feature (476)..(476): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggcccgggggggtccctgagactctcctgtgaagcctctggattcaccttgagcacttattggatgacgttgggtccgccaggctccgaggggagggctggagtgggtgccacatacaaaagntggaagtgacacaacctatgtgactctgtgatgggcattcaccgtctccagagacgacgacaagaactcactanatctgacaaatgaacactagagacgacgaggacacggactgtgtacttacngtgtgagagatgttctgcggttcgggccgagggaccctggactacccg

SEQ ID NO: 306736 - DNA, 555 bp, Homo sapiens
  misc_feature: GZ8MTXP02GVW4U.15.16.B05.1.454.CMB.2.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttattggatgacttgggtccgccaggctccgaggggaaggggctggagtgggtggccacataacaaaaagntggaagtgacacaacctatgtgactctgtgatggggccgattcaccgtctccagagacgacgaccaaagactcaactacatctgaacaaatcgaaacaaccgtgacgagaccgaggacacggctgtcgtattacgtgtgtgagagagttcgttcgtggtcggttcgggggaccacggggaacccctgggtacctacccgg

SEQ ID NO: 306737 - DNA, 548 bp, Homo sapiens
  misc_feature: GZ8MTXP02JIMAC.15.16.B05.1.454.CMB.2.raw
  modified_base (509)..(509): a, c, t, g, unknown or other
  misc_feature (509)..(509): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccgaggctccgaggggaggggctggagtgggtggccacataacaaaagataggaagtgacacaacctatgtgactctgtgatgggcctattcaccgtctccagacgacgacgacaagaactcactacatctagacaaatcgaaacaaccgtgaagacgaccggaggacacggctgtagtacttacgtgtgtgagagattgttcgnggtcggtcggggaccgacggacccgtcggtacctacccg

SEQ ID NO: 306738 - DNA, 560 bp, Homo sapiens
  misc_feature: GZ8MTXP02JLHDY.15.16.B05.1.454.CMB.2.raw
  modified_base (303)..(303): a, c, t, g, unknown or other
  misc_feature (303)..(303): n is a, c, g, or t
  modified_base (348)..(349): a, c, t, g, unknown or other
  misc_feature (348)..(349): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgagcctctggattcaccttgagcacttatggatgacgttggtccncaggctccgaggggagggctggagtgggtgccacataacaaaagnnggaatgacacaacctatgnactctgtgagtgggccattccaccgtcnccagacgacgaccgacaacgaactcaactacatctgaccaaagtcgaaacacctagaacgacggaccgaggacacggctgtgttactacgtgtgtagagacgtacttggttcgtggtcggttacgggggacctaacgggtaaccccgtcgggtaccctacccgg

SEQ ID NO: 306739 - DNA, 535 bp, Homo sapiens
  misc_feature: GZ8MTXP02JBPH4.15.16.B05.1.454.CMB.2.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccaggggaaggggctggagtgggtggccaccatacaaaagntaggaagtgacacaacctatgtgactctgtgatggggccattcaccgtctccagagacgacgcaagaactcactacatctgacaaatgaacaacctgagacgccgaggacacgggctgtcgtattacgtgtgtgagagtatcgttcgtgcggttggggaccgacgggaccctggtacctacccg

SEQ ID NO: 306740 - DNA, 573 bp, Homo sapiens
  misc_feature: GZ8MTXP02I5MO1.15.16.B05.1.454.CMB.2.raw
  modified_base (389)..(389): a, c, t, g, unknown or other
  misc_feature (389)..(389): n is a, c, g, or t
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgagcctctggattcactgagcacttatggatggcgttggggtcccgccgaggcctccgaggggaaggggcgtgggaggtggggtcggccaaccataaacaaaaagagtaggaagtgacacaacctatgtanactctgtgagtgggccgattccaccgtctccgagacgacgacgaccaagaacncactacatctgacaaatacgaaaccacctagacgagccgaggacncggntggtntattacgtgtgtagagtagtagttgtacgtggtcggttacgggggacccgaacggggtacccttgggaccctacccg

SEQ ID NO: 306741 - DNA, 572 bp, Homo sapiens
  misc_feature: GZ8MTXP02JVOXQ.15.16.B05.1.454.CMB.2.raw
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggattcaccttgagcacttattggatgacttgggtccgcgagctcggaggggaggcgtggaggtggcgaccacataaacaaaagtgtaaggaacgtacgaaccacgtaaacctagtacgtaacgaccttgtagtgtacggtcgggaccttactcccgaccgtctaccgagacgacacgtacaaagacctcaactacatcganaactaaganaaccacgtagagacgacgagtacgcgtntgtatactgngagagagtacgtcgttcgtcgaacggtcggtcggaccgtacggtccgtgtaccctcg

SEQ ID NO: 306742 - DNA, 585 bp, Homo sapiens
  misc_feature: GZ8MTXP02HNCJ1.15.16.B05.1.454.CMB.2.raw
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccgaggcccggggggtcctgagactctcctgtgagcctcgtggattcaccttgagcacttattgatgacgttgggtccgccaggctccgaggggaaggggctgggagtgggtgaccacatacaaaaagntaggaagtgaacacaacctatgtanacttctagtgagttcgggggcctaatttcccaccgttcctacccgagacgacgaacgcaaagaactacactacactctagactaaaagtgaaacaacctagagacgaccgaggaccacggtctagtacgtattcgngtcgtagagagtactggttctaaggtcggttacggggcccgaacggtacccgtcggtaccgtaccccg

SEQ ID NO: 306743 - DNA, 571 bp, Homo sapiens
  misc_feature: GZ8MTXP02HFZSG.15.16.B05.1.454.CMB.2.raw
  modified_base (358)..(358): a, c, t, g, unknown or other
  misc_feature (358)..(358): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactgggtggagtcgtgggggaggcctcgtccgagggcccggggggtccctggagactctcctgtgaagcctctggattcaccttgagcacttattggatgacgttggtcccgcaggctccgaggggagggctggagtgggcgccacataaacaaaaagntaggaagtgacacgaacctatgtagacctctgtgagtcggggacgtactccaccgtctaccagacgacgacgacaaagactcactacatcgactanaaatcgaaacaacctagaacgacggcgaacggacncggcttgagttattacgtgtgtagacgagtactgttcgtggtcgggttcgggaccgaacgggtacccctgggtaccctcccg

SEQ ID NO: 306744 - DNA, 595 bp, Homo sapiens
  misc_feature: GZ8MTXP02G2RJ7.15.16.B05.1.454.CMB.2.raw
  modified_base (388)..(388): a, c, t, g, unknown or other
  misc_feature (388)..(388): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagctacttattggatgacttgggtccgccgaggctccgaggggaaggggctggaggtggggtcgaccgacataacgaaaaagagtaggaacgtgacacaacctatgtanactctgtgagtggggaccattccaccgtctacccgagacgacgacgaccaagaacacactacagtctagacaaatcgaaacaaccgtagaacgacgaccggagaccgacgtcgtagtcgttaagttactggttgagaagagtacgttgtttcgtcggtacggggttacggggaccgtacggggtaaccccgtgggtaccctacccgg

SEQ ID NO: 306745 - DNA, 567 bp, Homo sapiens
  misc_feature: GZ8MTXP02IUAGM.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggacttaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgccagtctccgagggaggggctggagtgggtggccaccataacaaaaagatagggaagtgaagacaaacctatgtagaactctgtgatggggcctattcaccgtctccagagacgacgccaaagacctcaactacatctagacaaatacgaaacaacctgaagacgccgaggacacggctgtgtattactgtgtagagagtattcgttctggtcggttacgggggaccgtacgggggaacccgtcggtaccgtacccggtttccc

SEQ ID NO: 306746 - DNA, 683 bp, Homo sapiens
  misc_feature: GZ8MTXP02G2JC7.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggctccgaggggaggggctgggaggtgggtgcccacataaacaaaagataggaagtgaacaacgaaacctagtgtagactcgtggtagagttcgggggaccctatttcccacccggttctacccgacgaacgaccggaccgaccgtaaagaaacctcaaactacactactcgaactaaaagtcgaaaactaaccgtaggaacgacgtacccggaaggaaccgacggggtaccttagggtatttaaacgtttaccgtgggttacgggtggaaacggtaacgtacgtttggtttccggtcggggttaccgggggtttcggggggaccccggtaaaacgggggtaacccccgtttcgggggtacccctttaacccccggg

SEQ ID NO: 306747 - DNA, 590 bp, Homo sapiens
  misc_feature: GZ8MTXP02IHPDC.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctcgtggattcaccttgagctacttagtggatgacgttgggtccgccgaggctccgaggggaaggggctggaggtgggtcggcccaaccgaataaacgaaaaaagagtaggaaagtgaacaacaaacctatagtgactcgtgtgagtgggccattccaccgtctaccgagacgacgaccgaccaaagaactcaactacatctgacaaatagaaacacctagaacgacgaccgaaggacgacggcgtgtagttacttacgtgtggtagacgagtagttcgtacgtggtcggtcgggggaccaacggggacccgtcggtacctaccccg

SEQ ID NO: 306748 - DNA, 546 bp, Homo sapiens
  misc_feature: GZ8MTXP02FYV46.15.16.B05.1.454.CMB.2.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (435)..(435): a, c, t, g, unknown or other
  misc_feature (435)..(435): n is a, c, g, or t
  modified_base (479)..(479): a, c, t, g, unknown or other
  misc_feature (479)..(479): n is a, c, g, or t
  modified_base (489)..(489): a, c, t, g, unknown or other
  misc_feature (489)..(489): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccnccaggctccgaggggaggggctggaggtggtggccaccatacaaaagntaggaagtgacacaacctangtagactcnggtgagtgggccattccaccgtctcccagacgacgacaccaagaactcactacntctgacaaatgaacaacctgacgagccgaaggacacggctagtntaacttacgngtgtgagacgtatggttcnggtcggttacggggccaaggggacccttgggcctaccg

SEQ ID NO: 306749 - DNA, 628 bp, Homo sapiens
  misc_feature: GZ8MTXP02IO0N7.15.16.B05.1.454.CMB.2.raw
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccgaggccggggggtcctgagactctcctgtgagcctcgtggattcaccttgagcacttatggatgacttgggccncnggctccgagggagggctggaggtggtgccacataacaaaagntaggaatgacacaactatgacactctgtgagtcgggccaattccgaacccgtntacccgagtacgaccgacgacccaaagtaaacctacgaacctacataccgtagaacctaaaagtcgaaaccctaaaccgtaggaagaccggacccggaagggaaccgtaaccggccgttaggtaggtttaacttacgttaggtacggtagaaggtacgtaattcggttactaagggtccggttacgggggccccaaacggggtacccctttgggtaaccccgtaccccg

SEQ ID NO: 306750 - DNA, 643 bp, Homo sapiens
  misc_feature: GZ8MTXP02GYLF0.15.16.B05.1.454.CMB.2.raw
  modified_base (475)..(475): a, c, t, g, unknown or other
  misc_feature (475)..(475): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccagggccggggggtccctgagactctcctgtgaagcctctggattcaccttgagcacttattggatgacgttgggtcccgccgaggcctacccggaggggaaggggctgggaggtggggtcggcccaaccaataaacaaaaagagtaggaaagtcgaacaacaacctatgtagacttcgtgtaggagtcggggacctattccgacccgtctaccagacgacgacgaccaaacgactcaactacatacngaactaaatacgaaacaaccgagaacggaacgacccggaaggaaccgaccggtacgtaggtagttaattaccgtgtacggtaggtaagacgtaagttggtttacgtcgggtcggtttacgggggacccgtaaacggggtaaccccgttcggggtacccttaaccccgg

SEQ ID NO: 306751 - DNA, 586 bp, Homo sapiens
  misc_feature: GZ8MTXP02JAM6P.15.16.B05.1.454.CMB.2.raw
  modified_base (364)..(364): a, c, t, g, unknown or other
  misc_feature (364)..(364): n is a, c, g, or t
  modified_base (493)..(493): a, c, t, g, unknown or other
  misc_feature (493)..(493): n is a, c, g, or t
  modified_base (537)..(537): a, c, t, g, unknown or other
  misc_feature (537)..(537): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagctacttatggatgacgttgggtcccgcgaggctaccgaggggaaggggcgtggaggtgggtcgccaccaataaacgaaaaagngtaggaagtgaacacaacctatgtagactcgtggtagagtcggggactattcccaccgtctaccgagacgaccgacgaccaagaactcactacatctagacaaatcgaaacactagagacgcgaggacncggtctgtacgtattacgtggtagtagaagtgtagttgttacgngggtcggttacggggaccctaacggggtacccctgggtaccctacccgg

SEQ ID NO: 306752 - DNA, 607 bp, Homo sapiens
  misc_feature: GZ8MTXP02HG1M9.15.16.B05.1.454.CMB.2.raw
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagctacttattggatgacgttggggtcccgccaggcctccgaggggaggggctgggaggtgggtggccacataaacaaaagntaggaagtgaacacaacctatgtagactctgtgagtggggcctattccaccgtcaccagacgacgacgacaagactcactanatctagacaaatacgaaacaccgtagaacgacgacggaaggacgacggctaggtcgttaagttacgttggtacggtaggaaggtagtagttcggtttcgtgggtccggggtttacgggggcccggtaaacggggtaacccccgttcgggtacccgtaacccccgg

SEQ ID NO: 306753 - DNA, 615 bp, Homo sapiens
  misc_feature: GZ8MTXP02G9SV1.15.16.B05.1.454.CMB.2.raw
  modified_base (380)..(380): a, c, t, g, unknown or other
  misc_feature (380)..(380): n is a, c, g, or t
  modified_base (488)..(488): a, c, t, g, unknown or other
  misc_feature (488)..(488): n is a, c, g, or t
  modified_base (532)..(532): a, c, t, g, unknown or other
  misc_feature (532)..(532): n is a, c, g, or t
  modified_base (571)..(571): a, c, t, g, unknown or other
  misc_feature (571)..(571): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtgggtggagtcggtgggggacggcctcggtccgacgggcccggggggtccctggacgacctctccgtgtgaagcctctggacttcaccttgagctacttagttggatgtacgttcgggtccgccgaggcctaccggaggggaaggggctgggaggtgggtcgccacataaacaaaagngtaggaacgtgaacacgaacctagtgtagactctggtgacgttcggggccgtattcccgaacccgtctacccgaagacggaccgacgaccaaagactcaacacatctnaacgaaatcgaaaccacgtagacgacgtacgaaggacaccgggntgtgttaacttcgtgtacgtggaacgagtagttgttcgnggttccggtcgggggaccacgggtaacctcgggtacctaccccg

SEQ ID NO: 306754 - DNA, 567 bp, Homo sapiens
  misc_feature: GZ8MTXP02IMA1B.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttatggatgacttgggtccgccaggctccgaggggaggggctggagtgggtgccaccataacaaaagatggaagtgaacacaacctatgtgactctgtgagtggggcctattccaccgtctcccagacgacgacgccaaagaactcaactacatactgacaaaatcgaaaccaacctagagacgaccgaggacacggtctagtcgttacttacgtgtagtaggaagtagtattgttcgtggtcggttcgggggacccaaggggaccccttgggacctaccccgg

SEQ ID NO: 306755 - DNA, 541 bp, Homo sapiens
  misc_feature: GZ8MTXP02ITLMI.15.16.B05.1.454.CMB.2.raw
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtctgggggaggcctcggtccaggccggggggtcctgagactctcctgtgaagcctctggattcaccttgagcacttatggatgacttgggtcccgcaggctccgaggggaggggctggagtgggtggccacataacaaaagatggaagtgacacaacctatgtnactctgnagtgggcattcaccgtctccagacgacgacgaccaagaactcaactacatctagacaaaatgaaaccaacctgaagacgaccgaggaacacggctgtcgtattactgtgtgagagattgttcgtgcggttcggggaccacggggaaccctggtactacccg

SEQ ID NO: 306756 - DNA, 525 bp, Homo sapiens
  misc_feature: GZ8MTXP02F1GVO.15.16.B05.1.454.CMB.2.raw
  modified_base (376)..(376): a, c, t, g, unknown or other
  misc_feature (376)..(376): n is a, c, g, or t
  modified_base (432)..(432): a, c, t, g, unknown or other
  misc_feature (432)..(432): n is a, c, g, or t
  modified_base (474)..(474): a, c, t, g, unknown or other
  misc_feature (474)..(474): n is a, c, g, or t
  modified_base (494)..(494): a, c, t, g, unknown or other
  misc_feature (494)..(494): n is a, c, g, or t
tcagtctacgtagccacgaccggtgctcgatttagagctcacgtattgggtttgaggtctcagagaggagccttagccctggactcccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccggggggtcctgagactctcctgtgaagcctctggattcaccttgagcacttattggatgacttgggtccgccaggctccgagggaaggggctggagtggggtggccaccataacaaaaagataggaagtgacacaacctangtgactctgtgagtgggcattcaccgtctccagagacgacgccaagactcactacntctgacaatgaacaacctgacgagccgagacaggctgtagtntactgtgtgagagatgttcnggcgttggggccacgggacctcggtcacccg

SEQ ID NO: 306757 - DNA, 576 bp, Homo sapiens
  misc_feature: GZ8MTXP02IC3GO.15.16.B05.1.454.CMB.2.raw
  modified_base (356)..(356): a, c, t, g, unknown or other
  misc_feature (356)..(356): n is a, c, g, or t
  modified_base (476)..(476): a, c, t, g, unknown or other
  misc_feature (476)..(476): n is a, c, g, or t
  modified_base (496)..(496): a, c, t, g, unknown or other
  misc_feature (496)..(496): n is a, c, g, or t
  modified_base (531)..(531): a, c, t, g, unknown or other
  misc_feature (531)..(531): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaggtgtccagtgtgaggtgcaacgtggtggagtcgtgggggagcctcgtccgagggccggggggtcctgagactctctgtgagcctctggattccacttgagctacttagtggatgacttgggtcccgcaggctcgagggagggcgtggaggtgggtggaccacaataaacgaaaaagngtaggaagtacgaccacaactatgtacgactcgtgtgacgtgggccgtattccacccgttcacgagacgacgacgaccaagactacactacatcctgtaccaaatacgaaacctaaccgngagaacgccggaagcacggntgtatattacgtggtagtgagtatgtttgttccgnggtccggttcgggggaccgtacggggtaccctggtcctaccccgg

SEQ ID NO: 306758 - DNA, 525 bp, Homo sapiens
  misc_feature: GZ8MTXP02JOE9R.15.16.B05.1.454.CMB.2.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccgaggccggggggtccctgagactctcctgtgaagcctctggattcaccttgagcacttattggatgacttgggtccgccaggctccgaggggaggggctggagtgggtgccacataacaaaagntagaagtgacacaacctatgtnactctgtgagtgggcctattcaccgtctccagacgacgacgaccaaagacctacactacatctgacaaatgaaacacctgagacgccgagacacggctgngtatacngtgngagngatgtcngcggttcgggcagggaccctggacctaccg

SEQ ID NO: 306759 - DNA, 526 bp, Homo sapiens
  misc_feature: GZ8MTXP02FGR0S.15.16.B05.1.454.CMB.2.raw
  modified_base (352)..(352): a, c, t, g, unknown or other
  misc_feature (352)..(352): n is a, c, g, or t
  modified_base (491)..(491): a, c, t, g, unknown or other
  misc_feature (491)..(491): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgaggggaaggggctggagtgggtggccaccatacaaaaagntggaagtgacacaacctatgtgactctgtgatgggcgattcaccgtctccagagacgacgcaagaactcactacatctgacaaatgaaacaacctgagagccgaggacacggctgtgtatactgtgtgagagatgttcngtcggttcggggccgagggaaccctggtctacccg

SEQ ID NO: 306760 - DNA, 558 bp, Homo sapiens
  misc_feature: GZ8MTXP02HIPU7.15.16.B05.1.454.CMB.2.raw
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
  modified_base (518)..(518): a, c, t, g, unknown or other
  misc_feature (518)..(518): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccagggccggggggtccctgagactctcctgtgagcctctggattcaccttgagctacttattggatgacgttgggtccgcaggctccgaggggagggctggagtgggtgccacataaacaaaagntaggaagtgaacactaaacctatgagactctgtagagtggggccattccaccgtntacccgagcgacacgacaaagactacactanatctagacaaatagaaccacgtagacgacgccggaaggtacacggtctagtagtactacgtgtgtagagtgacttgttcgnggtcggttcggggaccgacgggtaccctcggtcctacccg

SEQ ID NO: 306761 - DNA, 684 bp, Homo sapiens
  misc_feature: GZ8MTXP02ICZ1E.15.16.B05.1.454.CMB.2.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgagcctctggattcaccttgagcacttattggatgacttggtccgcaggctccgaggggagggctggagtgggtggccacataacaaaaagntaggaagtgaacacaaacctatgtacgactctgtgagttcggggaccgtatttcccaccccgttctacccgaaggacgaacccggaacccgaccgaaaacgaaacctccaaaccttacaactccgttacgaacctaaaaacgttaggaaaaccctaaccgtagaaacggaacggacccgggaaagggtacccgaacgggtccgttaggttacgttaacgtttaacgttgggtacgttaggaaggtaagtaccgtttggtttacgtcggggtacgggtttacgggggacccgtaacgggggtaaacccccgttcggggttaccctaacccccggg

SEQ ID NO: 306762 - DNA, 608 bp, Homo sapiens
  misc_feature: GZ8MTXP02IFAH5.15.16.B05.1.454.CMB.2.raw
  modified_base (370)..(370): a, c, t, g, unknown or other
  misc_feature (370)..(370): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggattcaccttgagcacttagtggatgacgttgggtcccgccgaggcctccggaggggaacggggcgtgggaggtgggtcggcccaacgaataaacgaaaaagngtaggaacgtagaaccaacaacctatgtacgactcgtagtagagtcggggacctattccgacccgtcaccgaagacgacgacacaaacgtacncaactanatctagaccaaatcgaacacgtgacgacgacgagtacncggntagtacttattacgtggtgtacggagtacgtgtttcgtaccgtgggtccgggttacggggacccgtaaacggggtccccgttgggtaccctcccgg

SEQ ID NO: 306763 - DNA, 553 bp, Homo sapiens
  misc_feature: GZ8MTXP02I0LWG.15.16.B05.1.454.CMB.2.raw
  modified_base (355)..(355): a, c, t, g, unknown or other
  misc_feature (355)..(355): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttattggatgacttgggtccgccaggctccgaggggaaggggctgggagtgggtgccacataacaaaagntaggaagtgacacaacctatagtgactctgtgagtcggggcattccaccgtctccagacgacgacgacaagaactcaactacatctagacaaagtcgaaacacctgaacgacgaccgaggacacggctgtagtacttacngtgtagagagtactgttcgtgcggttcggggccgacggggtaccctggtacctacccg

SEQ ID NO: 306764 - DNA, 570 bp, Homo sapiens
  misc_feature: GZ8MTXP02HQS8Q.15.16.B05.1.454.CMB.2.raw
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (411)..(411): a, c, t, g, unknown or other
  misc_feature (411)..(411): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtcgtgggggaggcctcgtccaggccggggggtccctgagactctcctgtgaagcctctggattcaccttgagcacttatggatgtacgttgggtccgccgaggctccgaggggaggggctggaggtgggtgccacataaacgaaaagntaggaacgtgaacacaacctatgtanactctgtgagtgggcctattcaccgtcnccgagagacgacgacaagactcactacatctagactaaatagaaaccaccgtagaagacgaccggaggaccgtacggctgtacgtattacgtgtagtcgagtagagttgttcgtggtcggttacggggaccgacgggtaccccgtggtacctaccccgg

SEQ ID NO: 306765 - DNA, 643 bp, Homo sapiens
  misc_feature: GZ8MTXP02ITAR9.15.16.B05.1.454.CMB.2.raw
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgacgggccggggggtccctgagactctcctgtgaacgcctctggacttcaccgttgagctacttagttggatgacgttcgggtcccgccgaggcctaccggaggggaaggggcgtgggaggtggggtcggacccaccaataaacgaaaagagtaggaagtacgacaacaacctatgtanactctagngacgtcggtcattccaccgtctaccgagacgacgacgacaacgactacactacatctacgaacaaagtacaaaccaacggtagaacgaacggaccggaacggaaccgtacgggaccgttaggttacgttaactttaacggttggtaggttaggagtaacggtattcggttacgtcggggtcgggttacggggaccgaaccgggtacccggttcggaccccttacccgg

SEQ ID NO: 306766 - DNA, 578 bp, Homo sapiens
  misc_feature: GZ8MTXP02IQCR5.15.16.B05.1.454.CMB.2.raw
  modified_base (387)..(387): a, c, t, g, unknown or other
  misc_feature (387)..(387): n is a, c, g, or t
  modified_base (454)..(454): a, c, t, g, unknown or other
  misc_feature (454)..(454): n is a, c, g, or t
  modified_base (493)..(493): a, c, t, g, unknown or other
  misc_feature (493)..(493): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagctctcctgtgacgcctcgtgatcactgagtctattatggatgacgttgggcccgccgaggctccgaggggaacggggctgggaggtgggtcgcccaacataaacgaaaagagtaggaacgtgacacaacctatgtagactntgtgagtcggggactacttccaccgtcaccagacgacgaacgacaagactcaactacactacacganaaaacgtcgaaaaccacgtagagacggaccggtagaacncggcgtgtagttactagttgtcgtagacgtgacttgttcgtcggtcgggttacgggaccgtacgggtacccgttggacctacccg

SEQ ID NO: 306767 - DNA, 669 bp, Homo sapiens
  misc_feature: GZ8MTXP02JOP6W.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagactctcctgtgagcctcgtggattcaccttgagctacttattggatgacgttgggtccgccgaggcctccgaggggaaggggctgggaggtggggtcggccaaccgaataaacgaaaaagagtaggaaagtagaacaactaaacctatggtacgaccttcgtaggtgaagtcggggacctactttcccgacccgttcctacccgaaggaaccggaccgaacccgaccaaacggaaacctaccaactacacttacgtagaacaaaagtcgaaaacccaaccgtagaacgacggccggaaaggaccgaccggacgttagtagttacttacgtggtagtaggaagtagtagttcggttacgtgggtccggggtttacgggggacccggtaacggggtaacccgttcggggtacccttaaccccgg

SEQ ID NO: 306768 - DNA, 593 bp, Homo sapiens
  misc_feature: GZ8MTXP02HV0DM.15.16.B05.1.454.CMB.2.raw
  modified_base (358)..(358): a, c, t, g, unknown or other
  misc_feature (358)..(358): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccaggccggggggtccctgagactctcctgtgaagcctcgtggacttcaccttgagcacttattggatgacgttggggtcccgccgaggctccgaggggaaggggctggagtggggtgccacataacaaaaagntaggaagtgaacacaacctagtgtagactcgtgtgagtcgggccatttcccgaccgtctcccaggacgaccgacgaccaaagaacctcaacttacatcctagaccaaaatacgaaacctaaccgaggaacgaggcccggaaggaccgacggcttaggtntaacgttacgtgtagtggacgtagtcttgtactgggtcggttcggggacccaggggtacccctggtacctaccccg

SEQ ID NO: 306769 - DNA, 559 bp, Homo sapiens
  misc_feature: GZ8MTXP02IXN60.15.16.B05.1.454.CMB.2.raw
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (475)..(475): a, c, t, g, unknown or other
  misc_feature (475)..(475): n is a, c, g, or t
  modified_base (513)..(513): a, c, t, g, unknown or other
  misc_feature (513)..(513): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccaggccggggggtcctgagactctcctgtgaagcctctggattcaccttgagcacttattggatgacttgggtcccncgaggctccgaggggaagggctggagtggtgccacataacaaaagntaggaagtgacacaacctatgcgactctgtgagtggggaccgtattccgaccgtctacccgagagacgaccgacaagaacctcaactacatctgacaaatgaaaccactgaacgagccgtagacncggactgtgtactatggtgtgaatagtacttgtttcgngtcgggttacggggaccgtaacgggaaccctgggtaccctacccgg

SEQ ID NO: 306770 - DNA, 763 bp, Homo sapiens
  misc_feature: GZ8MTXP02HG733.15.16.B05.1.454.CMB.2.raw
  modified_base (391)..(391): a, c, t, g, unknown or other
  misc_feature (391)..(391): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgacggccggggggtccctgagactctcctgtgagcctctggatcaccttgagctacttatggatgacgttcgggtcccgccaggtcctccggaaggggaacgggggtctaggggagggttcggggtacgggccccaacccgaattaaaaccgaaaaaaaggngttaaggggaaaagtcggaaaccctaaaccaaaccgttaagtcggttacgtaaccttcgtaggtaggtaagtcgggggtaccaactttcccgacccgttaccttacccgaacgaacggaaacccggaacccggaacccaaaacggtaacctaacctaaacccttaacgaactttacctaacggtaaaccaaaacgttaaccgaaaaccctaaacccgttaaggaacggaaccggaacccggtaacgggaaccgaaccgggtcgttaggtacgttaagttacttagggtcgttaggacgtacgtagttggtttcgtcgggtcgggttacgggggacccggtaacgggaaccccggttcggtccccgtacccgg

SEQ ID NO: 306771 - DNA, 616 bp, Homo sapiens
  misc_feature: GZ8MTXP02JJUTO.15.16.B05.1.454.CMB.2.raw
  modified_base (375)..(375): a, c, t, g, unknown or other
  misc_feature (375)..(375): n is a, c, g, or t
  modified_base (535)..(535): a, c, t, g, unknown or other
  misc_feature (535)..(535): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggattcaccttgagcacttattggatgtacgttcggggtcccgccgaggcctaccgagggggaacggggcgtgggaggtggggtcggcccaaccaataaacgaaaaagngtaggaagtgaaccactaacctatgtacgactctggtgagtcggggcctattccgacccgttcacccgaagacgaccgacgaccaaagaacctcaactacattcgtagaacctaaatacgaaacctaccgtagaacgacgaccggaaggtacaccgggtntgtattacttgtgtagtagagtagtacgttcgtcgtgggtcgggtacggggaccgtaccgggtacccgtcggtacctcccg

SEQ ID NO: 306772 - DNA, 650 bp, Homo sapiens
  misc_feature: GZ8MTXP02JSXRU.15.16.B05.1.454.CMB.2.raw
  modified_base (408)..(408): a, c, t, g, unknown or other
  misc_feature (408)..(408): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgagcctctggattcaccttgacgctacttagttggattgtacgttcggggtcccgccgaggccgtccggaggggaaggggcgtgggaggtcggggtcgacccaaccaataaacgaaaaagagtaggaagtgaaccaacaaacctataganactctagtgagtcggggaccgtattccgacccgtctaccgagacgaccgacgaccaacgaactcaactacatctagacaaaagtcgaaaccaaccgtaggaaacgacggaccggaacgggaccgaacgggtctaggttacgttaacgttacgtggttacggtagtaggtaggtactttcggttcgtggggtcgggttaccgggggaccgtaaccggggtacccgtccggtaccctaccccgg

SEQ ID NO: 306773 - DNA, 555 bp, Homo sapiens
  misc_feature: GZ8MTXP02JCKAD.15.16.B05.1.454.CMB.2.raw
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttattggatgacttgggtccgccgaggctccgaggggaggggctggagtgggtggccaccgataacaaaagntaggaagtgacacaactatagngactctgtgatgggctatcaccgtctccagacgacgacgaccaagactacactacatctagacaaatcgaaacaccagaacgacgaccgaggacacggctgtgtacttactggtgtagagtagtattgttcgtggtcggttcggggaccgacggggtaaccctggtaccgtaacccg

SEQ ID NO: 306774 - DNA, 581 bp, Homo sapiens
  misc_feature: GZ8MTXP02GP40H.15.16.B05.1.454.CMB.2.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctcgtggattcaccttgagcacttattggatgacgttgggtccgccaggctccgaggggagggctggagtgggtggccacataacaaaaagntaggaagtgacacaaacctatgtagactcgtgtgagtggggacctatccaccgtctaccgagacgaccgaacgaccgaaagaacctcaactaacactcgtagacaaatgaaaccaaccgtagagacgccggaaggacgacggctgtgtacttacgtgtagtaggagtagtacgttgttacgtggtacgggttcggggaccacgggtaacccctgggtacctacccg

SEQ ID NO: 306775 - DNA, 528 bp, Homo sapiens
  misc_feature: GZ8MTXP02I195P.15.16.B05.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (490)..(490): a, c, t, g, unknown or other
  misc_feature (490)..(490): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtcctgagactctcctgtgaagcctctggattcaccttgagcacttattggatgacttgggtccnccaggctccaggggaagggctggagtgggtggccacataacaaaagntggaagtgacacaacctatgnactctgtgatgggccattcaccgtctccagagacgacgccaagactcactacatctgacaaatgaacaactgagagcgaggacacggctgtgtattacgtgtgtagagacgatgttcgnggtcggttcggggccagggaccctgggtacctacccgg

SEQ ID NO: 306776 - DNA, 577 bp, Homo sapiens
  misc_feature: GZ8MTXP02HI37D.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagctctggatcaccttgagcacttattggatgacttgggtccgcgaggctccgaggggaaggggctgggaggtgggtggccaccataaacaaaaagataggaagtagacaacaactatgtagactctgtgagtcggggccgtattccaccgtctaccgagacgacgacgaccaaagaactcactacatctgacaaatagaaacaaccgtagaagacgaccgaaggacacggctagtagttacttactggtagtggaagacgtagttgttcgtggtcgggttcggggacccgacggggtaacccctggtaccctacccgg

SEQ ID NO: 306777 - DNA, 604 bp, Homo sapiens
  misc_feature: GZ8MTXP02G0JRI.15.16.B05.1.454.CMB.2.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgagcctctggattcaccttgagcacttattggatgtacgttgggtcccgccgaggctccgaggggaggggctggaggtgggtcgccacataacaaaagntaggaagtgacacaactatgtagactctgtgagtcggggaccattccacccgtctacccgaagacgaccgaccgaccaaacgaacctacaacctacagtactagacaaatcgaaaccaccgtagaagacggaccggaagggacgtaccgggacttgtagtacttacgtggtacgtggaagtagtacttggttacgtggtcgggttacgggggaccgaacggggtaccccttcgggtaccctaccccgg

SEQ ID NO: 306778 - DNA, 604 bp, Homo sapiens
  misc_feature: GZ8MTXP02H0GMP.15.16.B05.1.454.CMB.2.raw
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccgcaggctccgaggggaagggctggagtgggtgccaccatacaaaagntaggaagtgacacaactatgtagactctgtgatggggccattccacgtctaccgagacgacgacgaccaaagactcaactacatctgactaaatacgaaacaaccgtagaacgacggacccggaaggaccgaacggctaggtagtttaattaccgttggttagtaggaaacgtaggtactttaggttccgtaacgggtcgggtttacgggggacccgtaacgggggtaaacccccgttgggttacccgtaccccgg

SEQ ID NO: 306779 - DNA, 597 bp, Homo sapiens
  misc_feature: GZ8MTXP02GF2EA.15.16.B05.1.454.CMB.2.raw
  modified_base (361)..(361): a, c, t, g, unknown or other
  misc_feature (361)..(361): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttatggatgacgttgggtccgccaggctccgaggggaaggggctgggaggtggggtcgccaccataaacaaaaagngtaggaagtgaaccaacaaacctatagtagactctaggtgagtcggggcctattccacccgtctacccgagacgacgacgaccaaacgaactcaactacatactagaacaaatacgaaaccaaaccgtgaaacgacgaccggaaggacgacggctagtagtacttacgtgtgtagagagtattgttacgtggtcggttcggggaccgtaacgggtaacccgtcggtacctacccgg

SEQ ID NO: 306780 - DNA, 555 bp, Homo sapiens
  misc_feature: GZ8MTXP02I2G08.15.16.B05.1.454.CMB.2.raw
  modified_base (447)..(447): a, c, t, g, unknown or other
  misc_feature (447)..(447): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgacgactctcctgtgaagcctctggattcaccttgagcacttattggatgacttggggtcccgccaggctccgaggggaagggctggagtgggtgccacatacaaaagatggaagtgacacaacctatgtagactctgtgatggggccattcaccgtctccagacgacgacgaccaacgaactcactacatctgacaaagtnaacactagaagagaccgagacaggctgtntacttacgtgtgtgaagngtaagttgttcgtggtcggttcgggggaccgtacggggtaccccgtggtacccgtacccgg

SEQ ID NO: 306781 - DNA, 704 bp, Homo sapiens
  misc_feature: GZ8MTXP02H02FU.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtcctgagactctcctgtgacgcctctggattcaccttgagctacttagttggatggtacgttggggtcccgccgaggcctacccggagggggaaacggggtctggggaggttcgggggtcggcccaacccgaaataaaaccgaaaaaaaggagtaaggggaaacgttacggaaaccctaaaccaaaacccgttaattcggttacgaaccttcgttggtaggagttcgggggcccgtaaatttcccgaacccgttcctacccgaagacggaacgaaccgacccaaacgaaccttaccaaaccttacatacctagaaccaaaagtacgaaaacccaccgtagaacgaacgaccggaaggacgaacggtctaggttacttaagttacgttggagttagacggtagagtttcgtcgtggtcgggttacggggacccgtaacgggaccccgttcggtacctaccccgg

SEQ ID NO: 306782 - DNA, 631 bp, Homo sapiens
  misc_feature: GZ8MTXP02I2SF8.15.16.B05.1.454.CMB.2.raw
  modified_base (457)..(457): a, c, t, g, unknown or other
  misc_feature (457)..(457): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgagactctcctgtgagcctctggattcaccttgagcacttattggatgacgttggtcccgcaggctccgaggggaaggggctgggaggtgggtcgccaacataaacgaaaagagtaggaagtgacacaacctatgtagactctgtgagtcggggaccgtattccgacccgtcctacccgaggaacgaccgaacgaccaaagaacctcaacctanatcctagaaccaaagtcgaaaacctaccgagaacgacggacgacggaacgaccggtntggttagttatttaacgtggttaggtaggaaccgtagtagtttccgttaggtcgggttacgggtttacgggggacccgtaacgggggtaaccccgttcgggtacccgttacccccgg

SEQ ID NO: 306783 - DNA, 529 bp, Homo sapiens
  misc_feature: GZ8MTXP02IN5XF.15.16.B05.1.454.CMB.2.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggagcctcgtccaggccggggggtcctgagactctcctgtgaagcctctggattcaccttgagcacttatggatgacttgggccnccaggctccgagggagggctggagtgggtgccacatacaaaagntggaatgacacaactntgtnactctgtgatggggcattcaccgttnccgagagacgacgacaagaactcaactacntactgacaaatgaacacngacgngacgagacncgactgtcgtatctagtgtagagtacgattgtacgtggtcggttcggggaccgaacgggtaccctcggtacctaccccg

SEQ ID NO: 306784 - DNA, 570 bp, Homo sapiens
  misc_feature: GZ8MTXP02ICKFX.15.16.B05.1.454.CMB.2.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaacgtggtggagtcgtgggggagcctcgtccgaggccgggggtccctgagactctcctgtgagcctctggattcaccttgacgcacttagttggatgacttcgggtccgcaggctccgaaggggaggggctgggagtgggtcgccacataaacaaaaagntaggaagtgaacacaacctatganactctagngagtcggggccattccacccgttnccagacgacgacgaccaaagactacactacatctagacaaatgaaactacgagagacgacgaggacaggtcgtgtagttattacgtgtagtagaagtacgtattcgtcgtcgggcgttacgggggaccgtacggggtaccccgtcggtaccctacccg

SEQ ID NO: 306785 - DNA, 686 bp, Homo sapiens
  misc_feature: GZ8MTXP02F63Y3.15.16.B05.1.454.CMB.2.raw
  modified_base (414)..(414): a, c, t, g, unknown or other
  misc_feature (414)..(414): n is a, c, g, or t
  modified_base (586)..(586): a, c, t, g, unknown or other
  misc_feature (586)..(586): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagactctcctgtgaagcctcgtggacttcaccttgagctacttagttggatgtacgttcggggtcccgccgaggcctaccggagggggaaggggcgtgggaggtggggtcggccaaccgaataaacgaaaaagagtagggaagtagaaccaactaaacctatacggtanaccttgtggtaggagtcggggaccgtattccgacccgttctacccgaagggaacgaaccggaacccgaaccaaaacggtaaacctacctaaacctaaacacgttacctagaaactaaaacgtacaaaacctaaaccgagaaacggacggaccggaacgggaacgaccgggtnttaggttacgttaattacgtggttgtaggaagtagtacgtttgttcggtaagtcggggttacgggaccgtaaccggggtaacccgtcggtacctacccgg

SEQ ID NO: 306786 - DNA, 557 bp, Homo sapiens
  misc_feature: GZ8MTXP02FKQ3H.15.16.B05.1.454.CMB.2.raw
  modified_base (359)..(359): a, c, t, g, unknown or other
  misc_feature (359)..(359): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
  modified_base (512)..(512): a, c, t, g, unknown or other
  misc_feature (512)..(512): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccgaggcccgggggggtccctggagactctcctgtgaagcctctggattcaccttgagcacttatggatgacttgggtccgccaggctccgaggggaaggggctgggagtggggtgccaccataacaaaagntaggaagtgaccacaacctatgtagactctgtgagtggggccgtattccaccgtctccagacgacgacgaccaagaactcactacatctgacaaatgaaacacngacgagcgaggacacggctgtgtacttacgngtgtgagacgtatgttcngggtcggttgggggacccgtaggggtaccccgtggtacctacccg

SEQ ID NO: 306787 - DNA, 579 bp, Homo sapiens
  misc_feature: GZ8MTXP02GUQN6.15.16.B05.1.454.CMB.2.raw
  modified_base (530)..(530): a, c, t, g, unknown or other
  misc_feature (530)..(530): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggcctccgaggggaaggggctggagtgggtggccaccataacaaaaagataggaagtgacacaaacctatgtagactctgtgatcgggccattcaccgtctaccgagagacgacgacaaagactacactacatctagacaaatgaaacaaccgtagacgacgaccggaggacaccggatcggtagttacttacgttgtgttagaagtacgtagttcgtttcgngggtcggttaccgggggccaacgggggtacccctggtaccctaccccgg

SEQ ID NO: 306788 - DNA, 689 bp, Homo sapiens
  misc_feature: GZ8MTXP02JX7G1.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggcctcgtccgaggccggggggtccctgagactctcctgtgaagcctctggacttcaccttgacgctacttagttggattgtacgtttcggggtccgccgacggccgtccggagggggaaggggcgtggggaggtggggtcggcccaaccgaagtaaaccaaaaaggagtagggaaacgtacgaaccaacctaaacctagtcgtagtacctcgttaggtacggtacgtcgggggaccgtacttacccgtaacccgttcctaccgaaggaaccgacgacccgaccaaacgaactccgaacctacacttacctacgaacaaatacgaaaccaaccgtagaacgacggaccggaaggaccacgggtacctaggttagttaacgttaacgtggtacggtagtaggacgttagttcggttcgtaacgggtcggggttacggggaccggtaccgggtaccccggtcgtaccgtacccg

SEQ ID NO: 306789 - DNA, 526 bp, Homo sapiens
  misc_feature: GZ8MTXP02JZBI9.15.16.B05.1.454.CMB.2.raw
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgaggggaagggctggagtggnggccacatacaaaagntggaagtgacacaacctatgtgactctgtgatgggccattcaccgtctccagagacgacgccaagactcacacatctgacaaatgaaacactgagagcgaaggacacggctagtcgtatactagtgtgagagatgttcgtggtcggttggggcccaggggacccctggtacctacccg

SEQ ID NO: 306790 - DNA, 628 bp, Homo sapiens
  misc_feature: GZ8MTXP02G4HK6.15.16.B05.1.454.CMB.2.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (569)..(569): a, c, t, g, unknown or other
  misc_feature (569)..(569): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgagggccggggggtcctgagactctcctgtgaagcctcgtggattcaccttgagcacttatggatgacgttggtccncaggctccgaggggagggctggagtgggtgccacataaacaaaaagntaggaacgtgaacaacaaacctatagtagacttcgtaggtaggagtcggggacctagtttcccgaccgtctacccgagaacgaacgaccgaccaaagaacctacaactaacatacctagaaaccaaaagtacgaaaaccaaccgtagaaacgacgacccgaaggacctacggctagtagttacttacgtggtacgtagaagacgtagttcggtttcncgggtaccgggttacgggggacccgaacggggtaacccctttgggtacccttaccccgg

SEQ ID NO: 306791 - DNA, 560 bp, Homo sapiens
  misc_feature: GZ8MTXP02H5ERS.15.16.B05.1.454.CMB.2.raw
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtcccgccaggctccgaggggaggggctggagtgggtgccaccataacaaaaagntggaatgacacaacctatgtnactctgtgatggggccattccaccgtctcccagagacgacgaccaagaactcactacatctcgacaaatgaaacacctgagagccggaggacacggtactgtgttacttacgtgtggtgacgagattgttacgtggtcgggttcgggggcctaacggggtaacccccgttgggtaccctacccgg

SEQ ID NO: 306792 - DNA, 563 bp, Homo sapiens
  misc_feature: GZ8MTXP02FZ3Y3.15.16.B05.1.454.CMB.2.raw
  modified_base (359)..(359): a, c, t, g, unknown or other
  misc_feature (359)..(359): n is a, c, g, or t
  modified_base (525)..(525): a, c, t, g, unknown or other
  misc_feature (525)..(525): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccgggggggtccctgagactctcctgtgagcctctggattcaccttgagcacttattggatgacttgggtccgccaggcctccgaggggaaggggctggaggtgggtggccaccataacaaaaagntaggaagtgacacaacctatgtgactctgtgagtggggccgattccaccgtctccgagacgacgacgaccaagaactcactacatctgacaaatagaaacaaccgtagaacgacgaccggaggacacggactggtagttattacgtgtgtagagagtactgttcgnggtcggtcgggaccgagggtacccgtggtacctacccg

SEQ ID NO: 306793 - DNA, 587 bp, Homo sapiens
  misc_feature: GZ8MTXP02GIVBM.15.16.B05.1.454.CMB.2.raw
  modified_base (265)..(265): a, c, t, g, unknown or other
  misc_feature (265)..(265): n is a, c, g, or t
  modified_base (396)..(396): a, c, t, g, unknown or other
  misc_feature (396)..(396): n is a, c, g, or t
  modified_base (485)..(485): a, c, t, g, unknown or other
  misc_feature (485)..(485): n is a, c, g, or t
  modified_base (516)..(516): a, c, t, g, unknown or other
  misc_feature (516)..(516): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgtgctattttagaaggtgtccagtgtgaggtgcaacgtggtggagtcgtgggggagcctcgtccaggccgggggggtccctgagactctcctgtgagcctcnggattcaccttgagctacttatggatggacttgggtcccgccgaggccgtccgaggggaaggggcgtgggaggtggggtcggacccaaccgaataaacaaaaaagatagggaagtagaccaacaaacctanagttagactctggtagagtcggggacattcccaccgtctaccgagacgacgacgaccgaaagaactacactacattccagacctaaaanaacgaacaacgagagacgacggagacgacgngtagtagtactagtgtagagagagtactgtcgtggtcggtacgggaccgacggtaccgtcggtaccgtccg

SEQ ID NO: 306794 - DNA, 578 bp, Homo sapiens
  misc_feature: GZ8MTXP02IJASH.15.16.B05.1.454.CMB.2.raw
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagactctctgtgaagcctcgtggattcaccttgagctacttatggatgtacttgggtccgcaggctccgaggggaggggctggaggtggtgccacataacaaaagntaggaagtnacacaactatganactntgtgagtcgggctattccaccgtcaccagacgacgacgaccaaagacctcaactacatctagactaaaatacgaaacaccgtagacgacgaccgaaggacacggtcgtagtacgttacttacgtggtacgtagaagagtagttgttccgtggtcgggttacggggacccgtaacgggtaaccccgtcgggtacctaccccg

SEQ ID NO: 306795 - DNA, 612 bp, Homo sapiens
  misc_feature: GZ8MTXP02G8526.15.16.B05.1.454.CMB.2.raw
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggattcaccttgagcacttatggatgacgttgggtcccncgaggctccggaggggaggggcnggaggtgggtcggccacataaacaaaagngtaggaagtagacacaactatgnactctggtgagtcggggactattcccaccgtctaccgagacgaccgacgaccaagaactacactacactctagaactaaactacgaaaccaaccgtaggaacgacggacccggaaggaccgacgggtcttaggtggttaacttacgtggtggtagaaggtgtaacttggttacgtcggtacggggtttcgggggacccgtaacggggtaccccgttcggtacccgtacccgg

SEQ ID NO: 306796 - DNA, 697 bp, Homo sapiens
  misc_feature: GZ8MTXP02FSDXD.15.16.B05.1.454.CMB.2.raw
  modified_base (403)..(403): a, c, t, g, unknown or other
  misc_feature (403)..(403): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccggggggtcctggagactctcctgtgaagcctctggattcaccttgagctacttagtggatgacttgggcccgcgaggcgtccgaggggagggcgtggaggtgggtcggccaccgaataaacaaaaagagtaggaagtcgaacactaacctatgtagtactcttggtanaggtgggaccgtacttaccacccgttcacccgagaacgaccggaaccgaaccaaacgtaaacctctaactaacgacttacgtacaaccaaaatacgaaaaccttaaacccgaggaaacggaccggaacccggtaagggaacccgacggggtacgtttacgggtaggtttaaactttacggttgggttagtaacgggtaagtaacggttagttcggtttacgtaagggggttccgggtacgggggtaccccgtaacgggggtaaccccgttcggggtaccccgtttaacccccgg

SEQ ID NO: 306797 - DNA, 484 bp, Homo sapiens
  misc_feature: GZ8MTXP02IL60Q.15.16.B05.1.454.CMB.2.raw
  modified_base (258)..(258): a, c, t, g, unknown or other
  misc_feature (258)..(258): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (436)..(436): a, c, t, g, unknown or other
  misc_feature (436)..(436): n is a, c, g, or t
  modified_base (438)..(439): a, c, t, g, unknown or other
  misc_feature (438)..(439): n is a, c, g, or t
  modified_base (441)..(441): a, c, t, g, unknown or other
  misc_feature (441)..(441): n is a, c, g, or t
  modified_base (443)..(446): a, c, t, g, unknown or other
  misc_feature (443)..(446): n is a, c, g, or t
  modified_base (449)..(449): a, c, t, g, unknown or other
  misc_feature (449)..(449): n is a, c, g, or t
  modified_base (451)..(452): a, c, t, g, unknown or other
  misc_feature (451)..(452): n is a, c, g, or t
  modified_base (454)..(456): a, c, t, g, unknown or other
  misc_feature (454)..(456): n is a, c, g, or t
  modified_base (458)..(458): a, c, t, g, unknown or other
  misc_feature (458)..(458): n is a, c, g, or t
  modified_base (460)..(468): a, c, t, g, unknown or other
  misc_feature (460)..(468): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccagggccggggggtcctgagctctcctgtgancctctggattcaccttgagctacttattggatgacttgggtccncagctcgaggggagggctggagtgggtgccacataacaaaaagngtagaagtgaacacaactntgtagactntgtgagtcgggcattccaccgtcaccagagacgacgacctaaagactcaactacagtcaganannanannnncgngnngnnntntnnnnnnnnngngcgcgcgcncgcnc

SEQ ID NO: 306798 - DNA, 549 bp, Homo sapiens
  misc_feature: GZ8MTXP02JYZU3.15.16.B05.1.454.CMB.2.raw
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttctgttagctattttagaaggtgtccagtgtgaggtgcaactggtggagtctgggggaggcctcgtccagccggggggtcctgagactctctgtgaagctctggattcaccttgagcactattggatgactggtccncaggctcaggaagggctggagtcggtgccacatacaaaaganagagnganacaacatgnganactgtgagtgacgtactacaccgtactacacgagacgacgacgaacaacacaactacactactacgacaanagaacaacagagacgacgacgacgacgacgtagtagtacgtacgtagtacgtagtacgacgacgtacgttacgtaacgtacggtacgggtaccggtacggtacccgtacggtaccgtaccg

SEQ ID NO: 306799 - DNA, 607 bp, Homo sapiens
  misc_feature: GZ8MTXP02F3RU0.15.16.B05.1.454.CMB.2.raw
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (561)..(561): a, c, t, g, unknown or other
  misc_feature (561)..(561): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagcctctggattcaccttgagcacttattggatgacgtttcggggtccnccgaggctccgaggggaaggggctgggaggtgggtcggccaccgaataacaaaaagntaggaaagtgaacaacaaacctatgtagactcgtgtgaagtcggggaccgtattcgacccgttctacccagaacgaccgaccgaccgaaagaacctcaactaacatactagacaaatacgaaaccaaccgtagaagacgaccggaaggacacggactcgtagttaacttacgtggtagtgaagtacgtatcggttcnggtcggttgggggacccaacggggtaaccctgggtaccctacccgg

SEQ ID NO: 306800 - DNA, 597 bp, Homo sapiens
  misc_feature: GZ8MTXP02IB494.15.16.B05.1.454.CMB.2.raw
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccagggccggggggtcctgagactctctgtgagcctctggattcaccttgagcacttatggatgacttgggtccgcaggcctcgaggggagggcgtggaggtgggtggccaacataaacgaaaaagngtaggaacgtgaaccacaaacctatgtacactcgtgtagtagtcggggcctatttccacccgtctccagacacgacgaccaagaactcaactacatctagacaatagaaccaacctaggacgacgacgaggacacggcgtagtacgttattacgtgtgttaggagtagtactttggttcgtaacgggtccgggttacgggggacccgtaacgggggtacccccgtttgggacccttacccccgg

SEQ ID NO: 306801 - DNA, 900 bp, Homo sapiens
  misc_feature: GZ8MTXP02JH79Q.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgacgcctctggattcaccttgacgctactttagttggaatcggtacgtttcggggtaccccgccgagggccgttacccggaaggggggaaacgggggtccgttaggggaacggggttcgggggtttacgggacccccaaacccgtaaaattaaaacccgaaaaaaaaggtacggttaggggaaaacggttacggaaaccctaaacccgtaaaacccctttaagttacggttaacgtaacccgtttcttaggggtacggtaacggttccgggggacccgttaacgtttcccgaaaccccgttcccgttaacccgaacgggaacggaacccggaacccggaaccccaaaacggtaaaccctacccaaaccttacctaaacttccgttacggaaacctaaaaagttaccggaaaacctaaaacccgtagggaaacgaaccgggaacccccgggtaaaggggaaccctaccgggggacctttaggttaaccggtttaagttttaccggttaaagggttcggtttaagggaacgtagggttaacgtttacggtttacccgggttgggttccccgggggtttacggggggaccccggtaaaaccgggggtttaaccccggttccggggttaccccgtttaaacccccggg

SEQ ID NO: 306802 - DNA, 648 bp, Homo sapiens
  misc_feature: GZ8MTXP02JOTBE.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggagccgtcgtccgagggccggggggtcctgacgactctcctgtgaagcctcgtggattccaccttgagcacttatggatggacgttgggtccgccgaggccgtccggaggggaaggggcgtggggaggtcggggtcggacccaaccaaataaacgaaaaagagtagggaaagtacgaacaactaaacctagtgtagaccttcgtagtagagtcggggacctacttccgacccgtctaccgaagacgaccgaccgaccaagaacctcaactacatctagaacaaatacgaaacctaaccgagaaacgacggaccggaacggtaaccgcggtacgttaggtacgtttattacgtgtggtagaaggtacgtagttcgttcgtcgggtcgggttacggggaccgtaacgggtacccgtcgggtaccttacccgg

SEQ ID NO: 306803 - DNA, 635 bp, Homo sapiens
  misc_feature: GZ8MTXP02I7ASX.15.16.B05.1.454.CMB.2.raw
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttatggatgacttggggtccgccaggcctccgaggggaaggggctgggaggtggggtggccaccataacaaaaagntaggaagtgaacacaactatgtagacttcnggtgagtcggggccgtattccaccgtctacccagagaccgacgaccaagaactcgaactacactactagacaaaatcgaaaccaccgtagaacgacggaccggaagggtaaccgacggtacgtggttagttacgtttacgttggttcggtaggtaaggtacgtaacgtttggtttcgtaacgggttcggtttacgggggacccgtaacggggtacccccgttacggggtaccccgtttaccccgg

SEQ ID NO: 306804 - DNA, 570 bp, Homo sapiens
  misc_feature: GZ8MTXP02ISN7A.15.16.B05.1.454.CMB.2.raw
  modified_base (392)..(392): a, c, t, g, unknown or other
  misc_feature (392)..(392): n is a, c, g, or t
  modified_base (469)..(469): a, c, t, g, unknown or other
  misc_feature (469)..(469): n is a, c, g, or t
  modified_base (527)..(527): a, c, t, g, unknown or other
  misc_feature (527)..(527): n is a, c, g, or t
  modified_base (535)..(535): a, c, t, g, unknown or other
  misc_feature (535)..(535): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccggggggtccctgagactctcctgtgaacgcctctggattcaccttgagctacttatggatgacttgggtcccgccgaggctccgaggggaaggggctggagtggggtcggccaaccgataaacgaaaagagtaggaagtgaaccacaaacctatagngtactctgtagagtgggcgacttcacccgttctacccgaggaacgaccgaacgacccaagaaactcaactacatacngacaaatcgaaaccacctagagacgcgaggacacggatgtagtactacgtgtgtgagngtatcgtntggcggttcgggaccgtacggacccgtgacctccg

SEQ ID NO: 306805 - DNA, 554 bp, Homo sapiens
  misc_feature: GZ8MTXP02GL8F7.15.16.B05.1.454.CMB.2.raw
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (455)..(455): a, c, t, g, unknown or other
  misc_feature (455)..(455): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgagcctctggattcaccttgagcacttattggatgacttggggtcccnccaggcctccgaggggaagggctggagtgggngccacataacaaaagntaggaagtgacacaactatgtgactctgtgagtgggccattccaccgtctcccagacgacgacgaccaagactcactacatctagacaaatcgaacaaccngacgacgacgaggacacggctgtagtacttacgtggtagtagagagattgttcgtggtcggttacggggaccgagggtaaccccgtggtacctacccgg

SEQ ID NO: 306806 - DNA, 675 bp, Homo sapiens
  misc_feature: GZ8MTXP02HW0RK.15.16.B05.1.454.CMB.2.raw
  modified_base (383)..(383): a, c, t, g, unknown or other
  misc_feature (383)..(383): n is a, c, g, or t
  modified_base (582)..(582): a, c, t, g, unknown or other
  misc_feature (582)..(582): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggagcctcgtccgaggccggggggtcctgagctctcctgtgagcctctggacttcaccttgagctacttagttggatggtacgttcggggtcccgccgaggcctccgaggggaacggggctaggggaggttggggtcggacccaaccgaagtaaacgaaaaaaggntagggaaacgtcgaaccaactaaaccttagtacggtagtaaccttcgtaggttggaacgttcgggggaccctattttcccgaacccgttcacccgaaaggacggaaccgaacccgtaccaaaacgtaacctacaacttacattacgtcgaaactaaaatacgaaactaaccgtagacgacgaccggaggtacaccggtntggtacgttaattacgtggtcgtaggagtacgtagttgttacgtcggtcggttacgggggacccaagggggtaccccttggtaccctacccgg

SEQ ID NO: 306807 - DNA, 567 bp, Homo sapiens
  misc_feature: GZ8MTXP02JSRK1.15.16.B05.1.454.CMB.2.raw
  modified_base (379)..(379): a, c, t, g, unknown or other
  misc_feature (379)..(379): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (509)..(509): a, c, t, g, unknown or other
  misc_feature (509)..(509): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgagggccgggggtccctgagactctcctgtgagcctgtggattcaccttgagctacttagtggatgacttgggtccgcgaggctccgaggggaggcgtggaggtgggtcgccacataaacaaaagataggaacgtgacacaactatgtanactctgtgagtgggcattccaccgtctccagacgacgacgaccaaagactacacanacttcngaacctaaangaaacaacctgaagacggaccggagaacgcgcgtgttagtacttacgtgtgtagacgngtacgttgttcgtggtcggttcggggaccgtacgggtaacccgtcggtacctacccgg

SEQ ID NO: 306808 - DNA, 544 bp, Homo sapiens
  misc_feature: GZ8MTXP02HU1N4.15.16.B05.1.454.CMB.2.raw
  modified_base (373)..(373): a, c, t, g, unknown or other
  misc_feature (373)..(373): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggcctcgagggagggctggagtgggtgccacataacaaaaagtaggaagtgacacaacctatgtanactctgtgagtgggccattcccaccgtctccagacgacgacgaccaagaactcactacatctagacaaatgaaaccaacctagaagacgaccgaaggacacggctgtatacttactgtgtgagacgtatgtctggacggttcggggaccagggaaccctggtcctacccgg

SEQ ID NO: 306809 - DNA, 634 bp, Homo sapiens
  misc_feature: GZ8MTXP02IBGWU.15.16.B05.1.454.CMB.2.raw
  modified_base (368)..(368): a, c, t, g, unknown or other
  misc_feature (368)..(368): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccagggccggggggtcctgagactctcctgtgaagcctcgtggattcaccttgagctacttattggatgacgttcgggtcccgcgaggcctaccgaggggaacggggctgggagtggggtcgcccaccataaacgaaaaagntaggaacgtgaccacaacctatgtacgactctggtagagttcggggcgtattccgacccgtctaccgagagaccgacgaccaacgaactcaactacagtactgaacaaatcgaaaactaccgtaggacgacggaccggaacggacgaacggcttaggtagttaacgttacgttggttcggagaggtaacgtagttcggttacgtcggtacgggggtttacggggacccggtaacgggtaaccccggttcggtacccgttaccccgg

SEQ ID NO: 306810 - DNA, 542 bp, Homo sapiens
  misc_feature: GZ8MTXP02IO106.15.16.B05.1.454.CMB.2.raw
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggagcctcgtccagccggggggtccctgagactctcctgtgaagcctctggattcaccttgagcacttatggatgacttgggtccgcaggctccgagggaagggctggagtggtgcacataacaaaagntgaagtgacacaactangtnactctgtgatggggccattcaccgtctacccagacgacgacgaccaaaggaactcaactacatctagacaaatgaaacacgtanagngacgagacacggctgtgtattactagtgtagagtagacttgttacnggtcggtttcggggaccgaacgggtaaccccgtggtaccctacccgg

SEQ ID NO: 306811 - DNA, 645 bp, Homo sapiens
  misc_feature: GZ8MTXP02JBBUO.15.16.B05.1.454.CMB.2.raw
  modified_base (264)..(264): a, c, t, g, unknown or other
  misc_feature (264)..(264): n is a, c, g, or t
  modified_base (377)..(377): a, c, t, g, unknown or other
  misc_feature (377)..(377): n is a, c, g, or t
  modified_base (567)..(567): a, c, t, g, unknown or other
  misc_feature (567)..(567): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagactctcctgtgagcctcnggattcaccttgacgctacttagttggattggacgtttcggggtccccgccgaggcctccgaagggggaacggggcgtgggaggtggggtcggaccaccaataaacaaaaagngtaggaacgtacgaacacaaaccttagtacgttacgaccttcgtaggtagaacgtcgggggaccctaatttcccgacccgtctacccgaagacgacgacgaccaaagactcactacatctagaacaaatcgaaaccaaccgtgaacgacgaccggaagggtaccacgggtctggtacgttacgtttacgnggtacgttagagtacgtagttcgttcgtcggtacgggttcggggaccgaacggggtaccctcgggtaccctaccccgg

SEQ ID NO: 306812 - DNA, 706 bp, Homo sapiens
  misc_feature: GZ8MTXP02IOG8R.15.16.B05.1.454.CMB.2.raw
  modified_base (182)..(182): a, c, t, g, unknown or other
  misc_feature (182)..(182): n is a, c, g, or t
  modified_base (410)..(410): a, c, t, g, unknown or other
  misc_feature (410)..(410): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttccttgttgctattttagaaggtntccagtgtgaggtgcaactggtggagtcgtgggggagcctcgtccgaggccggggggtccctgagactctcctgtgagcctcgtggacttcaccttgagtcctacttagttggatgtacgttcgggtcccgccgacggctaccggaggggaggggctgggtaggtcggggtagcccaacctaataaacgaaaaaggagtagggaaaccgtagaccaacctaaacttangttacacctcttgtgacgtcgggcctatttccgacccgttcacccgaaggacgaaccgaccgtacccgaaaacgtaacctacctaaacttaccaggttaccctaaggaacctaaaaacgttaccgaaaacgtaaaccccgtgaaacggaaccggacccgggtaaaggaccgaacgggtcttacggtagttaaccttagtggtacggtggaaacgtagggtcttcgtttcggtcgggttcgggtacgggggtacccgtaaaacgggggtccccgtagggtttaccccctaaccccgg

SEQ ID NO: 306813 - DNA, 590 bp, Homo sapiens
  misc_feature: GZ8MTXP02HD2JV.15.16.B05.1.454.CMB.2.raw
  modified_base (178)..(178): a, c, t, g, unknown or other
  misc_feature (178)..(178): n is a, c, g, or t
  modified_base (262)..(262): a, c, t, g, unknown or other
  misc_feature (262)..(262): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
  modified_base (505)..(505): a, c, t, g, unknown or other
  misc_feature (505)..(505): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgtgctattttagagtntccagtgtgaggtgcaacgtggtggagtcgtgggggagcctcgtccagggccggggggtcctggagactctcctgtgaagcctntggtatcacttgagtcacttattggaatgacgttgggccgcaggctccggaggggagggctgggaggtgggtcggccaacgaataaacaaaaagngtaggaacgtagacacaactagtggtanacctgtagtggagttcggggctacttccaccgttnacccgagacgtaccgacgacaaagacctagactacgattcagacaaagtanaacctacgngaacgcgtcgaacggtcaccgggtntagtacgtagtcgtaggtacgaggacgtagtcgttcggtcgtcggtacggtacggggaccgtaccgggtaccgtcggtacccgtc

SEQ ID NO: 306814 - DNA, 601 bp, Homo sapiens
  misc_feature: GZ8MTXP02JKV2T.15.16.B05.1.454.CMB.2.raw
  modified_base (312)..(312): a, c, t, g, unknown or other
  misc_feature (312)..(312): n is a, c, g, or t
  modified_base (460)..(460): a, c, t, g, unknown or other
  misc_feature (460)..(460): n is a, c, g, or t
  modified_base (498)..(498): a, c, t, g, unknown or other
  misc_feature (498)..(498): n is a, c, g, or t
  modified_base (521)..(521): a, c, t, g, unknown or other
  misc_feature (521)..(521): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggccgtcgtccgacgggccggggggtccctgagactctcctgtgaagcctctggattcaccttgagctacttattggatgtacgttgggtcccncgaggctccgaggggagggctggaggtgggtcgccacagtaaacaaaagagtaggaagtcgacaacaactatagtagactcgtagtgagtggggccgtatcctaccgtctaccgagacgacgacgacaaacgactacaactacattcncgaataaatcgaaacaaccgtgaagacgacgacggacncggtactgtacgtaatttaccgnggtaggtacgtaaggtgtaagttcgttaccgtggtcgggttaccgggaccggtaacggtacccgtcgggtacctacccgg

SEQ ID NO: 306815 - DNA, 579 bp, Homo sapiens
  misc_feature: GZ8MTXP02GDWXV.15.16.B05.1.454.CMB.2.raw
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctggagactctcctgtgagcctntggatcaccttgagcacttatggatgacttgggccncaggctccgagggaggggctggaggtgggtcgccaccataacaaaaagntaggaagtgacaanacctatgnactctggtnagtgggcctattcgacccgtctacccgagaacgacgaccgaccaaacgaactacactacatacgtagaccaaaatcgaaacctaacgtagaacgacgacccgaaggaccgaacggtctagtagttaatacgttggtgtagagtagtacttgttcgtggtcggttcgggggaccgaacgggaccgtcggtacctacccgg

SEQ ID NO: 306816 - DNA, 541 bp, Homo sapiens
  misc_feature: GZ8MTXP02H9C8C.15.16.B05.1.454.CMB.2.raw
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (466)..(466): a, c, t, g, unknown or other
  misc_feature (466)..(466): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaagtgtccagtgtgaggtgcaactggtggagtcgtgggggaggcctcgtccagggccggggggtccctgagactctcctgtgaagcctcgtggattcaccttgagcacttatggatgacttggtccgcaggctccgaggggaagggctgggagtgggtggccaccagtaaacaaaagngtaggaacgtgaacacaaactatgagacctntgtgagtgggccaattcccaccgttcnccagacgaccgacgaccaagtacncaactanacgtcngactaaanagaacaacanagagacgacgacgacgctgtgtactatgtgtgagagactgtgtgtcggtcgggcgacggaccgtacgcgtacccg

SEQ ID NO: 306817 - DNA, 607 bp, Homo sapiens
  misc_feature: GZ8MTXP02H4RAV.15.16.B05.1.454.CMB.2.raw
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (476)..(476): a, c, t, g, unknown or other
  misc_feature (476)..(476): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtcctgagctctctgtgacgcctctggattcaccttgagcacttatggatgtacgttgggtccncaggcctccgagggaaggggctgggaggtgggtcggccaaccataaacaaaaagntaggaagtgaacaacaactatgtanactcgtgtagagtgggccgaatttccgacccttcgtccgaagacgaaccgaaccgaccaaacgaactaccaactacattctagactaaaagtanaaacccaactagagacgaccgaacggacgacggcgtgtaggtacttagtaggtgtgaacgtcgaacgtttggtcgttcggtcggggtttcgggaccggtaccgggtaaccccggtcggtacccgtaccccg

SEQ ID NO: 306818 - DNA, 619 bp, Homo sapiens
  misc_feature: GZ8MTXP02GMW71.15.16.B05.1.454.CMB.2.raw
  modified_base (260)..(260): a, c, t, g, unknown or other
  misc_feature (260)..(260): n is a, c, g, or t
  modified_base (368)..(368): a, c, t, g, unknown or other
  misc_feature (368)..(368): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcggtccgagggcccggggggtcctgagactctcctgngacgcctcgtggattcaccttgacgctacttagtcggatgacgttgggtccgccaggcctccgaggggaacgggctgggagtggggtcgaccacataaacgaaaaagngtaggaatgacacaactatgacgtactctgtaggagttcgggggacctacttacccgaccgttactcccgaagaacggaacggtacccgaccgaaacgtaacctacaactacactacgtacaaacgaaaatcgaaaccaaccgtagacgacgaccgagacgacggctgtagttactagtgtagtggagacgtattcgtacgtcggtcggtaccggggtactaaccggggtacccgtcggtacgtaccccgg

SEQ ID NO: 306819 - DNA, 609 bp, Homo sapiens
  misc_feature: GZ8MTXP02JLLY6.15.16.B05.1.454.CMB.2.raw
  modified_base (339)..(339): a, c, t, g, unknown or other
  misc_feature (339)..(339): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
  modified_base (527)..(527): a, c, t, g, unknown or other
  misc_feature (527)..(527): n is a, c, g, or t
  modified_base (542)..(542): a, c, t, g, unknown or other
  misc_feature (542)..(542): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgctatttagaggtgtcagtgtgaggtgcaagtggtggagtcgtgggggagcctcggtccgacgggcccggggggtccctggacgactctccgtgtagaacgcctctaggtacttcaccttgagctattagttggatgtacgttcggcccgcgaggccgtaccggagggggagggcgngggtaggtcgggtacgaccgacaataaacgaaaagagtaggaagtacgaaccaacaacttatgtacgtacgtgtagtaggtacgtcgggacctcgtaccnccgtacncgagacgacgacgacctaagacctacactanacttcgataaanaaagtcgaaaaccacgagacgagaccgagtacacggtntacgtgttaactggngtggagtagtagtcgttgttcggaacggtcgggtacgggacggtaaccggtccgttcgccgtacccg

SEQ ID NO: 306820 - DNA, 718 bp, Homo sapiens
  misc_feature: GZ8MTXP02GAAT8.15.16.B05.1.454.CMB.2.raw
  modified_base (306)..(306): a, c, t, g, unknown or other
  misc_feature (306)..(306): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagagtgtccagtgtgaggtgcaacgtgggtggagtcgtgggggagcctcgtccgaggccggggggtcctgagactctcctgtgacgcctcgtggattcaccttgagctacttagtggatgacgttgggtccncgaggcctccggaggggaaggggctgggagtggggtcggacccaacgtaagtaaacgaaaaaggcgtaggaacggtacgaacgaaacctaaaccttagtacggtacgtaacgttcgtaggtacggtaagtccgggggtacccgtaagtttacccgtacccgttaccgtacccgaacggaaccggaacccgggaaacccgaacccgaaaacgggtaaaccctacccgaaaccttaaaccgacgttaccgtacggaaccctaaaagtaccgaaaaccgaaacccgtaggaaacgacggaccggaacgggtaccgacggtaccgtagttacgtattacgtggtcgtaggagtagtagttgttacgtggtcggttacgggggacccgtaacgggtaacccgtcggtacctacccgg

SEQ ID NO: 306821 - DNA, 674 bp, Homo sapiens
  misc_feature: GZ8MTXP02JVHM9.15.16.B05.1.454.CMB.2.raw
  modified_base (278)..(278): a, c, t, g, unknown or other
  misc_feature (278)..(278): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccggggggtcctgagctctctgtgacgcctctggatcaccttgancacttatggatgtacgttgggtcccgcgacggcgtccggaggggaaggggcgtgggaggtgggtcggcccaaccaataaacaaaagagtaggaacgtagaacacaaacctatcgtagaccttcgtggtagtacgtcggggcctacttcccgacccgtcctacccgaacgaacggaaccgacgaacccaaacgtaacctacaacctacactactacgaaactaaacgtacgaaaccaaccggtaagaacggaacggaccgggaacggaaccgacggtacgtaggtaacgtttactttacgtggttacggtaggaacgttacggtagtttcggttcgtggggtacggggttccgggggaccggtaaccggggtacccgttcgggtacccgttccccgg

SEQ ID NO: 306822 - DNA, 781 bp, Homo sapiens
  misc_feature: GZ8MTXP02G4P1N.15.16.B05.1.454.CMB.2.raw
  modified_base (399)..(399): a, c, t, g, unknown or other
  misc_feature (399)..(399): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtggtgaggtgcaacgtggtggagtcgtgggggagcctcgtccgagggccggggggtcctgagactctcctgtgagcctcgtggattcaccttgagctacttagttggatggtacgttcggggtcccaccgaggccttcccggaagggggaacggggcgttaggggagggttcggggtacgggacccaaccgaataaaaccgaaaaaaggngttaggggaaacgtacgaaaccaaccgtaaaaccttagttcggttaacgtaacccgttgttagggttacggtaacgggtttccggggggacccttacgttttacccccgaaaccccgggttttccctaaaccccggaaagggaacgggaaacccggaacccggtaaaccaaaacggaaacccttacccaaaccttaacaactttacgacggaaacctaaaagttaacggaaaaccaacccggtagaacgaccggaacccggtaaggaacccggacggtccgtgttaacgttagttacgtggtacgtaggagtagtattggttcgtaacggtcggggttaccgggggacccgtaacggggtacccctcggtacccgtaccccg

SEQ ID NO: 306823 - DNA, 582 bp, Homo sapiens
  misc_feature: GZ8MTXP02JN8H6.15.16.B05.1.454.CMB.2.raw
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (542)..(542): a, c, t, g, unknown or other
  misc_feature (542)..(542): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcggtccaggccggggggtccctgagactctcctgtgaacgcctctggattcaccttgagctacttagttggatgacgttgggcccgcgaggctccgaggggaggggctggngtgtgtcggccacatacaaaaagntaggaatgaacacaactatgtgaactntgtgagtcggggacctattcaccgtctccgagacgacgacgaccaagaactcactacatcctagacaaatacgaaactaaaccgtgaacgacggacggaacggaaccgacgggacctgttacggtattacgttaggtatggagtacgtctggttcgnggtacgggttcgggaccgacggggtacccgtcggtacccg

SEQ ID NO: 306824 - DNA, 675 bp, Homo sapiens
  misc_feature: GZ8MTXP02JG0PQ.15.16.B05.1.454.CMB.2.raw
  modified_base (304)..(304): a, c, t, g, unknown or other
  misc_feature (304)..(304): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaggtgtccagtgtgaggtgcaactggtggagtcgtgggggagcctcgtccagggcccggggggtcctgagactctcctgtgagcctgtggattcaccttgagctacttatggatgacttgggtcccnccgaggcctaccgaaggggacggggctgggagttcggggtcggacccaaccgaataaacgaaaaagtcgtaggaaagttagaaccaaccaaaccttgtacgttacgaccttcgttagtacgacgtacggggcccttaaattcccgaacccgttctacccgagaacgaaccgtaaccgaccaaaagtaaccctacaacctacacttactacgaaactaaaagtccgaaaccaaccgtagaacgacgaaccggtaggaactacggtcgtagtacgttaacttacgtgttagaggaaacgtaggtatttcggtacgtgggtccggggttacgggaccggaaaccgggtccccgtaggggtacccctaaccccgg

SEQ ID NO: 306825 - DNA, 733 bp, Homo sapiens
  misc_feature: GZ8MTXP02HAOIT.15.16.B05.1.454.CMB.2.raw
  modified_base (263)..(263): a, c, t, g, unknown or other
  misc_feature (263)..(263): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtcctgagactctcctgtgagcctcnggatcaccttgagcacttatggatgacgttcggggtcccgccgaggcctacccggaagggggaacgggggtcgtaggggaggttgggggtcggtaccccaacccgtaaactaaaaccaaaaaaaagggtagtaaggggaaaggttacgaaaccgaacctaaaacccgttagtaggttacgtaaccttcgttggtagaagtcgggggccgtaactttcccaacccggttcctaccccgaaggaaccgaaccggaacccgacccgtaaaacgaacctacaaacctacacgttactacgaactaaaacgtacgaaaacctaaccgtagaacggacggacccggtaaggaaccgaaccggtcgtagttacgttaattacggtggttcggtagaaggtagtacgttgttcggtcgggtaccgggttacgggggtacccgaaccggggtaacccgttccgggtaccgtacccccgg

SEQ ID NO: 306826 - DNA, 781 bp, Homo sapiens
  misc_feature: GZ8MTXP02FXKJF.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcggtccgaggccggggggtcctggagactctcctgtgaagcctctggattcaccttgagctacttagttggatggtacttcggggtacccgccgaggcctccgaggggaaggggctgggagggtggggtcggacccaaccgtataaacgaaaaagcgttagggaaacgtgaaccaacgtaaacccttagtcgtagtaccgtctaggtgaagtcgggggacccacgttccaacccgttctacccgagaacgaacccgacggtaacccaaaggtaaccttaccaaccttaaacacgtttaccgtaggaaacctaaaaacgttcggaaaaacccctaaacccggtgaaaaccggacgggaacccccgggaaagggttaaccgacccgggggttacttagggttaaccggtttaaatttcccggttaaaggttcggggttaaacgaacgggttaaacgtaggtttacggtttacccgtgggggttacccgggggtttacggggggaccccgttaaaaccgggggtaaacccccgtttgggttacccccgtttaaacccccgg

SEQ ID NO: 306827 - DNA, 586 bp, Homo sapiens
  misc_feature: GZ8MTXP02F0F6V.15.16.B05.1.454.CMB.2.raw
  modified_base (359)..(359): a, c, t, g, unknown or other
  misc_feature (359)..(359): n is a, c, g, or t
  modified_base (515)..(515): a, c, t, g, unknown or other
  misc_feature (515)..(515): n is a, c, g, or t
  modified_base (551)..(551): a, c, t, g, unknown or other
  misc_feature (551)..(551): n is a, c, g, or t
tcagtctacgtagccacgaccggtgctcgatttagagctcacgtattgggtttgaggtcacagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccgagggccggggggtccctgagactctcctgtgagcctctggattcacttgagcacttatggatgacgttgggccgcaggctccggaggggagggctgggaggtgggtcgcccacgaagtaaacgaaaaagngtaggaagtcgacaacaacctagtgtacgactctaggtagagtcggggacctattccgaccgtctaccgagacgacgacgaccaagactacaactactatacgtacgaaactaaacgtcgaaacctaaccgtgaacgacggaccgaggacgacgtntagtatacttacgtgtgtagagtagtactgttacgnggtcggtacggaccgacggtacctcggtactcccg

SEQ ID NO: 306828 - DNA, 608 bp, Homo sapiens
  misc_feature: GZ8MTXP02HU1AB.15.16.B05.1.454.CMB.2.raw
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgagggccgggggtccctgagctctcctgngancctctggattcaccttgagctacttattggatgtacgttcgggtcccgccgacggccgtaccggaggggaaggggcgtggggagggtggggtcggccaaccaataaacgaaaaagntaggaacgtagaacaacaacctatggtanaccttntagtgagtcggggacctattccnccgtctcccgagacgaccgacgaccaaacgactcactacatctagaacctaaatacgaaacctaacgtgaacgacgaccggaagaccgtacgcgttagtacgttacttagtggtgtaggtagacgtgttgtcgtggtcggtacggggaccgacggtacccgtggtaccctaccg

SEQ ID NO: 306829 - DNA, 637 bp, Homo sapiens
  misc_feature: GZ8MTXP02HAHS3.15.16.B05.1.454.CMB.2.raw
  modified_base (486)..(486): a, c, t, g, unknown or other
  misc_feature (486)..(486): n is a, c, g, or t
  modified_base (558)..(558): a, c, t, g, unknown or other
  misc_feature (558)..(558): n is a, c, g, or t
  modified_base (575)..(575): a, c, t, g, unknown or other
  misc_feature (575)..(575): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggacggcctcgtccgacgggcccggggggtcctgagactctccgtgtagacgcctcgtggtattcaccgttgacgtactacttagttggattcggtacgttcgggtacccgccgacggccgtaccggaaggggaaggggcgtgggtaggtggggtacggaccaaccaagtaaacgaaaagtgtaggaagtacgaacaactaactagtcgagactcgtgtgacgtcgggcctatcccgaccgttcaccgagacgtaccgaccgacgaaanaacctcaactacgataccgagaaactaaagacgaaaaccacgtagaacgaccgacggacgtaacgaccggtntgtacgttatcgtggtntaggagtagtattcggttagcggtcgggtcggaccgtacgggacccctggtacccgtacccg

SEQ ID NO: 306830 - DNA, 591 bp, Homo sapiens
  misc_feature: GZ8MTXP02HA5Z7.15.16.B05.1.454.CMB.2.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtcctgagactctctgtgagcctctggattcaccttgagctacttattggatgacgttgggtcccgccaggcctcggaggaagggctggagtgggtcgccacataacaaaaagnagaacgtgacaacaactagtgagactctagtgacgtcgggacctattaccgaccgtctaccgaagacgaaaccgaaccgaccaaacgtaaccacaacctaacataccgtagaacaaacgaacgaaaccaaaccgacgaacgaacgacgacgacgacgacgtagtagttacttacgtagtgtagagacgtacgttagttacgtgtcggtacgggacggacggaccggtacggtacgtaccg

SEQ ID NO: 306831 - DNA, 541 bp, Homo sapiens
  misc_feature: GZ8MTXP02HJ30Z.15.16.B05.1.454.CMB.2.raw
  modified_base (180)..(180): a, c, t, g, unknown or other
  misc_feature (180)..(180): n is a, c, g, or t
  modified_base (211)..(211): a, c, t, g, unknown or other
  misc_feature (211)..(211): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgtagctatttagaggtgtcngtgtgagtgcaagtggtggagtcgtgggggngtcctcggtccgagggccggggggtcctgacgctctccgtgngacncctnggactcactganctatngatcgngtggccngcgcgnggaggnggngnggnggnggcgacacaanaaanaaanagagagagacacactatgtatntntgngtgcgtctactcnctcacgagacgacgacgacgacacacacactactacanaanaanaacgaacgacgagacgacggacgacggacgacgtacgtagtagtacgttagtagtagtaggacgtagtcgttcgttcggtcggtcgggtacggtaccggtaccggaccggtaccgtacgtcccg

SEQ ID NO: 306832 - DNA, 669 bp, Homo sapiens
  misc_feature: GZ8MTXP02FREIY.15.16.B05.1.454.CMB.2.raw
  modified_base (272)..(272): a, c, t, g, unknown or other
  misc_feature (272)..(272): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggccctttccacttggtgatcagcactgagcacagaggactcaccatggaattggggctgagcttgggttttccttgttgcttattttagaaggtgtccagtgtgaggtgcaactggtggagtcgtgggggaggcctcgtccgagggcccggggggtccctggagactctcctgtgagcctcnggattcaccttgagctattagtggatgtacgttcggggtcccgccgacggcctaccggaggggaggggtcgtgggaggtggggtcgccaacctaataaacgaaaaagngtaggaagtcgaacaacgaacctagtagtatacctgtgtagacgtcggggacctattacccacccgttcacccgaagaaccgacgaccgacaaacgaactaccaactacatacctagaactaaagtacgaaacctaacgtagaacggacggaccggaacgggaaccgacggcgttagttagttaacgttacgtggttaggtacgtaaggtacgttacgttggttacgtcgggttaccggggttacggggacccggtaacggggtaccccgtcgggtacccttaccccgg

SEQ ID NO: 306833 - DNA, 547 bp, Homo sapiens
  misc_feature: GZ8MTXP02GDBD8.15.16.B05.1.454.CMB.2.raw
  modified_base (331)..(331): a, c, t, g, unknown or other
  misc_feature (331)..(331): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctattttagaaggtgtccagtgtgaggtgcaactggtggagtcgtgggggagcctcggtccaggccgggggggtccctgagactctcctgtgaagcctctggattcaccttgagctacttatggatgacttggtccgcaggctccgaggggagggctggagtgggngccaccgataacaaaagtggaactgacacaactatgagactctgtgagtcggggacctatccgaccgtctacccgagacggacgaccgacaacgaactcactacattccagacaatagaacctacgngaagacgcgtagacgcgatgtntatactgtgtagagtacgtactgttcgcggtcgggtcgggaccgacgggtaacctcggactaccccg

SEQ ID NO: 306834 - DNA, 639 bp, Homo sapiens
  misc_feature: GZ8MTXP02GAMCL.15.16.B05.1.454.CMB.2.raw
  modified_base (599)..(599): a, c, t, g, unknown or other
  misc_feature (599)..(599): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtcagtgtgaggtgcaactggtggagtcgtgggggagcctcgtccgagggccggggggtcctgagacttctccgtgtgagcctcgtggattcaccttgagctacttagtggatgtacgttcgggtccgcgacggctaccggaggggaacggggctgggaggtggggtcgacccaacgaataaaacgaaaaagtacgtagggaaacgtacgaaccaaacgtaaccttagtacgtataccgttctaggtagtacgtcggggacctagtttacccacccgtctaccgaagacgaacgccgaaccaagaactcaactacacttacgtacgaactaaacgtcgaaacctaacgagaacggacgaccggaagaccgtacggtctaggtacttagttacgtgtcgtagagagttacgtgttcgnggtccggggtcggaccggacggtacccgtacgtctacccg

SEQ ID NO: 306835 - DNA, 617 bp, Homo sapiens
  misc_feature: GZ8MTXP02FYS5D.15.16.B05.1.454.CMB.2.raw
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccgggggggtccctgagactctcctgtgagcctctggattcaccttgagctacttattggatgacttggggccgccaggcctccgaggggaagggctggagtggggtcgccaccataacaaaaagntaggaacgtgacacaacctangtcgactctgtgagtcgggccattccacctctccagacgacgacgaccaagaactcactacatcgtgacctaaatgaaacaaccgtagaacgacgaccggaggtaaccgacggacgtaggtacgttaagttacgttaggttcggtagggtaaggtacgttagttcggtttacgtcgggttaccggggttcgggggtacccggaaccgggggtaacccgttcggggtacctaccccgg

SEQ ID NO: 306836 - DNA, 613 bp, Homo sapiens
  misc_feature: GZ8MTXP02JS7FU.15.16.B05.1.454.CMB.2.raw
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
  modified_base (538)..(538): a, c, t, g, unknown or other
  misc_feature (538)..(538): n is a, c, g, or t
  modified_base (571)..(571): a, c, t, g, unknown or other
  misc_feature (571)..(571): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggttttccttgttgctattttagaaggtgtccagtgtgaggtgcaacgtggtggagtcgtgggggagcctcgtccagggcccggggggtcctgacgactctcctgtgagcctctggattcacgttgagctacttatggatgacttgggtccncaggcctaccggaggggagggctggaggtgggtcgcccaaccaataaaccgaaaaagngtaggaaacgtcgaacaactaaacctgtagtacgacctgtaggtacgacgttacgggggccctatttcccgacccgttccacccgaagacgaaccgacccgaccaaacgtaacctaccaactaccagttccaggaccaaagtcgaaaccacgagaagacgccgaaggctacggntgtactatacgtgtgagacgagtacgtgttcgnggtcgggttacggggaccaggtacccgtcggtacctaccccg

SEQ ID NO: 306837 - DNA, 671 bp, Homo sapiens
  misc_feature: GZ8MTXP02JWTTJ.15.16.B05.1.454.CMB.2.raw
  modified_base (370)..(370): a, c, t, g, unknown or other
  misc_feature (370)..(370): n is a, c, g, or t
  modified_base (564)..(564): a, c, t, g, unknown or other
  misc_feature (564)..(564): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgagggcccggggggtccctggagactctctgtgagcctctggattcaccttgagcacttattggatgacgttgggtcccgcgaggcctccgaggggaaggggcgtagggaggtggggtcgcccaacgaataaacgaaaaagngtaggaacgtgaacaactaacctagtagtagactcgtggtacgagtcggggacctacgttaccacccgtttccacccgaaggtaaccgaaccggaacccgaaccgaaacgtaacctacctaacctactactacgtagaaactaaaacacgaaaacctaccgtagaacgacggaccggaaaggacctaccgggtntacgtagtttacgttacgtggtcgtagaggtacgtagtttcggttcgtaacgggttcggggttacggggacccgaacggggtacccgttcgggtacctaacccccgg

SEQ ID NO: 306838 - DNA, 548 bp, Homo sapiens
  misc_feature: GZ8MTXP02FTZ0I.15.16.B05.1.454.CMB.2.raw
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctcgtccaggccggggggtccctgagactctcctgtgagcctnggattcaccttgagctacttattggatgacttgggtccgccaggctccgaggggagggctggagtgggngccaccataacaaaagntaggaacgtgacacaacctancgtagactctaggtgagtgggcgattcacccgtntcccgagacacgacgacaagaactcactacntcagacaaatgaaacaacctgagacgacggaggacacggctagtacgtattacgtgtgtagacgtagattgtcgtgtacggtaggggcccagggtaccctgggtctacccgg

SEQ ID NO: 306839 - DNA, 622 bp, Homo sapiens
  misc_feature: GZ8MTXP02HUIGR.15.16.B05.1.454.CMB.2.raw
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccgggggtccctgagactctcctgtgagcctctggattcaccttgagcacttatggatgacgttgggtccgcgaggcgtccgaggggaaggggctgggaggtggggtgccacataaacgaaaaagngtaggaacgtgaacactaaacctatagtacgactactgtagtagtcgggccgtaattcccnccgttactaccgagacgaccgaccgacaaacgtacncactacntactgaaactaagtagaaacctactaggagacggaccgaggacgaacggtcgttagtacgttattcgtggttacgtagacgtagtatttcgggttcgtaagggtcccggggttacgggggacccgtaaccgggggtacccctttagggtccctaaccccgg

SEQ ID NO: 306840 - DNA, 739 bp, Homo sapiens
  misc_feature: GZ8MTXP02GNHUD.15.16.B05.1.454.CMB.2.raw
  modified_base (621)..(621): a, c, t, g, unknown or other
  misc_feature (621)..(621): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttaggaaggtgtccagtgtgaggtgcaacgtggtggagtcggtgggggacggtccgtcggtccggacggggcccggggggtccctggacgtaccttccgtccgtgtcggaacgtccgtcgtaggtacttcctaccttggacgtacttacgttagtggagttacgtcgtcggtccgccggagcgtcggaggggaggtcgtgggtacggtgggtacgacccaaccgtaaagtaaaacgaaaaagaggtacggaagtacgaaaccaactaaaccgtagtgttaagtaccgtcgtggtggacgtcggggacctaacttcctaccccggtataacccggacgaccgaaaacggacccgaccaaaacgacctaactaacctacgaacttccgaacgaaacaagttaacgaaacccgaggtacgaaaacggcggtaaccggaggttaacccgnggtacttaggttattacgtgggttagcggtaagaaggtacgtttcggttcggtttggtaacggggttacggggtacccgggggaccgttaacccgggaccctttcggtaccgtacccg

SEQ ID NO: 306841 - DNA, 644 bp, Homo sapiens
  misc_feature: GZ8MTXP02FT28M.15.16.B05.1.454.CMB.2.raw
  modified_base (212)..(212): a, c, t, g, unknown or other
  misc_feature (212)..(212): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (632)..(634): a, c, t, g, unknown or other
  misc_feature (632)..(634): n is a, c, g, or t
  modified_base (636)..(639): a, c, t, g, unknown or other
  misc_feature (636)..(639): n is a, c, g, or t
  modified_base (641)..(641): a, c, t, g, unknown or other
  misc_feature (641)..(641): n is a, c, g, or t
  modified_base (643)..(644): a, c, t, g, unknown or other
  misc_feature (643)..(644): n is a, c, g, or t
tcagtctacgtagccacgaccggtgctcgatttagagctcacgtattgggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtntccagagacgacgccaaagaactcactacatctgcaaatgaacaacctgagagccggagacacggntgtnttacttactgtgtgagagtattcgttcgtggtcgggttcggggaccgacggggaaccccttgggtccctaccggttctacccttcgaccgtcccctacccgaacgacgggtacccctagttcccgggttcccttccccccgtggggccccgtaccccgtgcccgtaccgagggtaccgacccaacccgtccgaagacgcgaaccgacggcccgcccgttgggcctcggtccgtggtaccgaaacgggtaccttacccgttaccggtaccgttaacggtacggaccgttagggaacgggtccggggtacggtcgggaaccgtaacggggtccgaccgaagttacgngngcnnngnnnncncnn

SEQ ID NO: 306842 - DNA, 614 bp, Homo sapiens
  misc_feature: GZ8MTXP02IMW9X.15.16.B05.1.454.CMB.2.raw
  modified_base (277)..(277): a, c, t, g, unknown or other
  misc_feature (277)..(277): n is a, c, g, or t
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcctcgtccaggccggggggtccctggagctctcctgtgagcctctggattcactganctacttatggatgacgttcgggccgccgaggcctccggaggggaggggcgtgggaggtgggtcggacccaccaataaacgaaaagagtaggaagtgaccacctaactagtagtacgacttcgtgtgagtcggggtaccgacttcccaccgtctaccgagaacgacgaaccgacaacgaacncactacatacacganaaaacgtacaaaccaaccgtagaacggaccggaccggaaggaaccgaccggtcgtacgtagttaattacgttggtacgtaggagagtacgttcgttcgtggtcgggttcgggaccgtacgggtaccctcggtacctacccg

SEQ ID NO: 306843 - DNA, 586 bp, Homo sapiens
  misc_feature: GZ8MTXP02HDAVI.15.16.B05.1.454.CMB.2.raw
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (478)..(478): a, c, t, g, unknown or other
  misc_feature (478)..(478): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgaggccggggggtccctgagactctcctgtgaagcctctggattcaccttgagctacttagttggattggacgtttcggggtcccgccgtaggcctaccggaagggggaacggggctggggaggtggggtcggcccacataaacaaaaagngtaggaacgtgaacacaactangtagactctgtgagtcgggacctattacccgaccgtctaccgagacggacaccgacaaagacctcaactacatacngaccaatacgaaacacgagacgcgacgaggacaggctgtgtaactcgtggtgtgagacgtatgttcgtggtcggttcggggccacggggtaccctggtaccctacccg

SEQ ID NO: 306844 - DNA, 770 bp, Homo sapiens
  misc_feature: GZ8MTXP02HGCNT.15.16.B05.1.454.CMB.2.raw
  modified_base (328)..(328): a, c, t, g, unknown or other
  misc_feature (328)..(328): n is a, c, g, or t
  modified_base (644)..(644): a, c, t, g, unknown or other
  misc_feature (644)..(644): n is a, c, g, or t
  modified_base (670)..(670): a, c, t, g, unknown or other
  misc_feature (670)..(670): n is a, c, g, or t
  modified_base (679)..(679): a, c, t, g, unknown or other
  misc_feature (679)..(679): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttagttttagaaggtgtccagtgtgaggtgcaacgtggtggagtcgtgggggacgcctcgtccgacgggccggggggtcctgagtactctccgtgtgacgtcctcgtggtattctaccttgacgactacttagtcggattggtacgttcggggtccccnccgaggtcctaccggaaggggacggggtctcggggagggttcggggtccggacccaacctaacgtaaaccgaaaaaaggtacgttaacggggaaagtaccggaaccaaaacccgtaaaaccgttagttacggtaaacgtacctttcgtacggttaggagggttccgggggtaccctaaacgtttcccgtacccgttacccgtacccggaaggtaaccggaaccggaacccgaaccaaaccggaactaccctaacactactaccgtacgaaactaaacgtacgaaaacccacgtagaacgaccggaccgaggtaccncggtacgtaggttactaacgtttggnggttaaggngtaacggtagttacgtttacgtttcggtaacgggttccggggtttccggggaacccggtacggtaaccccggtcgggttacccttccccgg

SEQ ID NO: 306845 - DNA, 642 bp, Homo sapiens
  misc_feature: GZ8MTXP02HO2P8.15.16.B05.1.454.CMB.2.raw
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (580)..(580): a, c, t, g, unknown or other
  misc_feature (580)..(580): n is a, c, g, or t
tcagtctacgtagccacgaccggtgctcgatttagagctcacgtattgggtttgaggtctcagagaggagccttagccctggactccaaggccctttccacttggtgatcagcactgagcacagaggactcaccatggaattggggctgagcttgggttttccttgttgctattttagaaggtgtccagtgtgaggtgcaacgtggtggagtcgtgggggagcctcggtccgagggcccggggggtccctggagactctcctgtgaacgcctcgtggtacttccaccttgganctacttagttggattggacgttcgggcccncgagtcgtccggaaggggaaggcgtaggggnggtggggtcgaccaacctaaagtaaaaccgaaaaagtcgtaggaagtaacgaacaacgtaacctagttacgtagtaaccttctgggtagacggtcggggacctacttcccaccgttcctacgagaacgacgacgtacaaacgaactacactacactctagaactaaactagaaaccacgtgaacgacgacggaaggtaccgacgtgtaagtgttaaactgtgtagnggaagtacgtgttgtgtcggtacgggtacggaccggtaccggaccgtagggtaccctacccg

SEQ ID NO: 306846 - DNA, 760 bp, Homo sapiens
  misc_feature: GZ8MTXP02ISWXI.15.16.B05.1.454.CMB.2.raw
  modified_base (566)..(566): a, c, t, g, unknown or other
  misc_feature (566)..(566): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggaggtcgtgggggagcctcggtccgacgggcccgggggggtcctggacgactctccgtgtgacgcctcgtggtacttctaccttgagctacttagtggattcggtacgttcgggcccgaccgaggccgtacgggaaggggaacggggcgtggggacgggttggggcggtacccaacaaacgtaaaaccgaaaaaaggtagtaggggaaacgtacgaaaccaaacctaaaccgtattacggtactacgttcgtaggtcggtacggtcggggtacctacgtttacccacccgttcacccgtaaggaaccggaaacccgacgaaaccccaaagaaccttacaacctaactactaccgtanaaaccgaaaacttaccgaaaccctaaccggtaggaaccggaccggccgggaaaggaacccgaggtaccgtttaggtacgtttaaacttcggttggtacggtaggaacgtagtacgtttcggtttcgcgggggttaccgggttacgggggtacccgaaaccgggggttaacccgttcgggtaacccctttcccgg

SEQ ID NO: 306847 - DNA, 863 bp, Homo sapiens
  misc_feature: GZ8MTXP02H0UV5.15.16.B05.1.454.CMB.2.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgcttattttagaaggtgtccagtgtgaggtgcaacgtggtggagtcgtgggggagcctcgtcgaggccgggggtcctgagactctctggtgacgcctcgtggattcgaccttgagctacttagtcggatggtacgttggggtcccgccgaggccgtacccgaagggggaaggggtccgtaggggtaggtcgggggtacggaccccaaccgtaagtaaaccgaaaaaaggtgtacgggaaaggtcgaaacacctaaaacccgtagttacggagtaaccgtttccgtaggtacggagttacgggggacccgtactttcccgaaacccccgttcgtacccgaaacggaacggaaacccggtaaacccgacccgtaaaaccgggtaaacctacccggtaaaccttaaccggtaacttaccggttaacaaaccgtaaaacgtttaaccggaaaaaccccgttaacccggtagggaaaaccggaaaccggggaccccggtaaaaccggggaacccggttaacccggggtaccggtttaaagttacgggtttaaaacctttaccggttacggttacggggtttaaacggaacgggttagggtaaaccgttttggttaccgggtttaacgggtaccggggttttaccgggggaccccggttaaaccgggggtaaccccgtacgggtttccccggtaaaccccccgg

SEQ ID NO: 306848 - DNA, 709 bp, Homo sapiens
  misc_feature: GZ8MTXP02JFR6E.15.16.B05.1.454.CMB.2.raw
  modified_base (261)..(261): a, c, t, g, unknown or other
  misc_feature (261)..(261): n is a, c, g, or t
  modified_base (417)..(417): a, c, t, g, unknown or other
  misc_feature (417)..(417): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggaggcctcgtccgagggccggggggtccctgagactctcctgngagctctggattccaccttgagctacttatggatgtacttgggtcccgcaggctaccggaggggaaggggcgtggagggtcggggtcgggccaaccgaataaaccgaaaaagagtaggaacgtagaaccaacaacctagtacgtacgactcgtggngtagtcggggacctagttccaacccgtctacccgagaacgaccgaaccgaccaaacgaaacctaccaactaaaccgtatacctagtaacaaaaacgtacgaaaaccgaaaccgtaggaaaacgacggaacccgggaacggaaaccgcggtacgttagtagttaaacgttaccgtggttacgggtaagtaacggtaacggttaacgtttggttcggttaacgggttccgggggttaccgggggaccgggtaaacccgggtaacccggtttacggtccccgtttaacccccggg

SEQ ID NO: 306849 - DNA, 694 bp, Homo sapiens
  misc_feature: GZ8MTXP02HVKVC.15.16.B05.1.454.CMB.2.raw
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
  modified_base (568)..(568): a, c, t, g, unknown or other
  misc_feature (568)..(568): n is a, c, g, or t
  modified_base (612)..(612): a, c, t, g, unknown or other
  misc_feature (612)..(612): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaacgtggtggagtcgtgggggacggcctcgtccgacgggccgggggggttccctggagactctccgtggtagacgcctctggattccaccttgagctacttagtggatggtaccgtttggggtccccgcaacgggtcctaccggaagggggaacgggggtctaggggaggggttcggggtacggtacccaaaccagtaaaaccgaaaaaaggngtaccgggaaacgtccgaaacaaccaaaacccggtttntagggtagaacctttgggtagttggacgttggggaccccttaaatttccccaacccgggttctcccgaagacggaaccaaccgtaccaaacgtaactcaaacttaccaattccgggtaaanaaacaaagtacgaaaccacgagacggacggtacgacgcgttcgnttgtacgttagtacgtggatggtaagtcgtattggttacggtggtcgggtaacgggaccgtacggtaccctggtacccaccg

SEQ ID NO: 306850 - DNA, 554 bp, Homo sapiens
  misc_feature: GZ8MTXP02FT14E.15.16.B05.1.454.CMB.2.raw
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggtttccttgtgctatttagaaggtgtccagtgtgaggtgcaactggtggagtcgtgggggagcctcgtccaggccggggggtcctgagactctcctgtgaagcctnggattcacttgagcacttatggatgactggtaccncagctcaggaggctggagtgggtgccacgatacaaaaagctaggaagtacgacacgaacctancgttagactctagttagacttggggacctatttcaacccgtctcccgaagacgacgaacgaccgaagaaactcaactacattaccngacaaaactgaaacctaacccganagacgacgagaacgcggctaggtntacttacgtntagtanacgagtactgttcgngtcggtacggacgacggtacgtcggtacctcg

SEQ ID NO: 306851 - DNA, 597 bp, Homo sapiens
  misc_feature: GZ8MTXP02JJIPR.15.16.B05.1.454.CMB.2.raw
  modified_base (266)..(266): a, c, t, g, unknown or other
  misc_feature (266)..(266): n is a, c, g, or t
  modified_base (326)..(326): a, c, t, g, unknown or other
  misc_feature (326)..(326): n is a, c, g, or t
  modified_base (459)..(459): a, c, t, g, unknown or other
  misc_feature (459)..(459): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgagggccggggggtcctgagactctcctgtgagcctcnggattcaccttgagctacttatgatgacgttgggcccgcaggcctccgaggggagggcgngggaggtggggtcgccaacaaataaaccaaaagagtggaaagtcgaacaccaaacctatggtagacttcgtagtgagtcggggacctatcccgtaccgtctaccgacgacgacgacgacaacgactacacacntactgaacaactagaaaccagtacgacgacgacgacggacacggctgtacgttagttacctaggtcgtaggtacgagtacgttgtacgtcgggtcgggtacggggaccggtacgggtaacccgtcggtaccttacccg

SEQ ID NO: 306852 - DNA, 736 bp, Homo sapiens
  misc_feature: GZ8MTXP02I25FZ.15.16.B05.1.454.CMB.2.raw
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgtgctattttagaaggtgtccagtgtgaggtgcaacgtggtggagtctgggggagcctcgtcaggccgggggtcctgagactctcctgtgaagcctctaggattcaccgttgngnacttntgatgactttgggaccnccgtaggcctccgaggggaacggggctggaggtcggtcggcctaccgataaccgaaaaaaggngtacggaacgtacaacgacctaaactataggtacgtacttcgttaggtacggtacgttccggggtacccgttagttacccgtacccgttacccgtacccgaacgaaccggaacccggaacccgaacccgtaaaacgtaacccctaacgtaacccttaccaacttacgtaccgaaactaaaacgttaacgaaaaccctaaccggtaacgaacgaccggaccggaaccgggaaaccgacggttacgtcggttacggtttaacgttacggtttacggtacggtagaaaggttacgtagtttacggtttcggttaacgggttccggggtaccggggtaacccgggtaaccggtaccccgttacgggttacccacccgg

SEQ ID NO: 306853 - DNA, 487 bp, Homo sapiens
  misc_feature: GZ8MTXP01B1OTB.3.77.G11.1.454.CMB.2.raw
  modified_base (268)..(268): a, c, t, g, unknown or other
  misc_feature (268)..(268): n is a, c, g, or t
  modified_base (485)..(485): a, c, t, g, unknown or other
  misc_feature (485)..(485): n is a, c, g, or t
tcagagacgcactccacgaccggtgctcgatttagctagtcactcaagggaaagggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaaccnggccaggctcccaggctcctcatctatgatgcatccacagggccacggtatcccagccaggttccagtggcagtgggtctggggcagagttcactctcaccatcagcagcctgcagtctgaggatttgctagtttattactgtcagcattacaataactggcctcggctcattcggcgagggccaaggtggagattcaaacgaatgtgctgcaaccntc

SEQ ID NO: 306854 - DNA, 513 bp, Homo sapiens
  misc_feature: GZ8MTXP01EJ8FM.3.77.G11.1.454.CMB.2.raw
  modified_base (418)..(418): a, c, t, g, unknown or other
  misc_feature (418)..(418): n is a, c, g, or t
  modified_base (509)..(509): a, c, t, g, unknown or other
  misc_feature (509)..(509): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtctccctctcctgcagggccagtcagagtgtcaacaacaacttagcctggtatcaacagaaacctggccaggctcccaggctcctcatctatgatgtgtcttctcgggtcacttggtctcccaggcaggttcagtggcagtggatcgtgggcagaattcacgctcaccatcatcaggctgcggtctgacacttcgcagtctatttcgtgtcaacngtacagtcggccggtcctccgtggactgttccgggaactaagggttccaaggttggacattcgagacgaactggtcggctggcctaaccgngttc

SEQ ID NO: 306855 - DNA, 600 bp, Homo sapiens
  misc_feature: GZ8MTXP01AD3MX.3.77.G11.1.454.CMB.2.raw
  modified_base (201)..(201): a, c, t, g, unknown or other
  misc_feature (201)..(201): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagatgccactggagaaatggggttgacgcagtttccagccaccctgtctgtgtctccgagggganagagccaccctctcctgcagggccagtcagagtgttgacagcaacttggcctggtaccagcagcaacnggccaggcctcccaggcctcctnatctatgatgcactcccaccgacgggccccaaccgggtactcccgaggccctaggttcccaggtggcgtaggtcgggtacgnggggaacaggtacgttcactctacacctatcagcagtcctgcacgtcgtaggaggttatttgcttaagttttattacggttgtactagtactaattaactaagttaacgtcgtcccgtcggtcctaccgtcggtttaacgggcgggttaacgggaccgttaagggtaggtaacgagttaaccgaaacggtaacgtaggtcggctcggacctaaccgttaacgttcg

SEQ ID NO: 306856 - DNA, 519 bp, Homo sapiens
  misc_feature: GZ8MTXP01D0ZCD.3.77.G11.1.454.CMB.2.raw
  modified_base (204)..(204): a, c, t, g, unknown or other
  misc_feature (204)..(204): n is a, c, g, or t
  modified_base (353)..(353): a, c, t, g, unknown or other
  misc_feature (353)..(353): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (495)..(495): a, c, t, g, unknown or other
  misc_feature (495)..(495): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagcccaccctgtctgtttctccaggggaaacngtctccctctcctgcagggccagtcagagtgtacaaacaacaacttagcctaggtatcaaacagaaacctggaccaggctccagctctcatctatgatgtgtcttcgtcggtcacgtggtcctccgagcaggttcagtgcagtgatcgnggaacagtaatcacgctcaccatcatcaggtctggcgtctgacgtactcgctagtctatttcgagtacaacgngtaccgngtcggccgtcgtcgtgactcgtcggaactaacggacgaggttcgaactgttacgagaacgtntggtcgcacgacctaaccttgttc

SEQ ID NO: 306857 - DNA, 532 bp, Homo sapiens
  misc_feature: GZ8MTXP01AXNW1.3.77.G11.1.454.CMB.2.raw
  modified_base (201)..(201): a, c, t, g, unknown or other
  misc_feature (201)..(201): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccagggaacngtctccctctcctgcagggccagtcagagtgtacaacaacaacttagcctaggtatcaacagaaacctggccaggctccaggctcctcatctatgatgtgtcttcgtcgggtcacttggtctcccaggcaggttcagtggcaggtgatcgtgggcagaattcacgctacacatcatcaggctgcggtctcgacgtacttcgctagtcttatttcgtgtacaagacgtacgagtcggcccggccttcccgtggactacgttccgggaaccaaagggttacccaagggttcggacagttcgagacgaactgtaacggctgcctaaccttgtcc

SEQ ID NO: 306858 - DNA, 555 bp, Homo sapiens
  misc_feature: GZ8MTXP01EKJRG.3.77.G11.1.454.CMB.2.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (345)..(345): a, c, t, g, unknown or other
  misc_feature (345)..(345): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagcccaccctgtctgttctccaggggaaacngtctccctctcctgcagggccagtcagagtgtacaaacaacaacttagcctaggtatacaacagaaacctggaccaggcctcccaggcctcctcatctatgatgtntcttctcgggtcacgtgtctccagctggtcagtggnaggtgatcgtgggaacagtaactcacgtctcacatcatcgaggctgcggtcngtacgcttcgctagttcttatttcgtagtacaaacgngtacgagtcgggccgtcctcggtggacctcgttacccgggaactaaagggttacccaaagggttcgaactagttaccgagacccgtaagtcggtcggctcggacctaaccgttaagttccg

SEQ ID NO: 306859 - DNA, 573 bp, Homo sapiens
  misc_feature: GZ8MTXP01D8N6B.3.77.G11.1.454.CMB.2.raw
  modified_base (353)..(353): a, c, t, g, unknown or other
  misc_feature (353)..(353): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtacaacaacaacttagcctaggtatcaacagaaacctggccaggctcccaggctcctcatctatgatgtgtcttctcgggtcactggtctcccgaggcaggttcagtggcagtgatcgngggcagaacttcacgctcacatcatcaggctgcggtctgacgtacttcgactagttacttatttcgtacgtttcaaacgtacgttacgattcgggcccggtcccttccggttgggacctagttccgggaacccttaaaggggttacccaaaggggttcggaaacctagttccgaggttaaccgaacgttggtcgggcctggcctaacccgttaagttccg

SEQ ID NO: 306860 - DNA, 568 bp, Homo sapiens
  misc_feature: GZ8MTXP01AMOD2.3.77.G11.1.454.CMB.2.raw
  modified_base (201)..(201): a, c, t, g, unknown or other
  misc_feature (201)..(201): n is a, c, g, or t
  modified_base (563)..(563): a, c, t, g, unknown or other
  misc_feature (563)..(563): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccagggaacngtctccctctcctgcagggccagtcagagtgtcaaacaactaacttagccctaggtatacaacaagaaacctggccaggcctcccgaggcctcctcatctatgatgtcgtcttcgtcgggtctacgtcggtcctccgaggctaggtcagtggcaggtggatcgtgggaacagtaacttcacgtctacacatcatcgaggctgcggtctgactacttcgctagttcttagttctgtacaacgtaggtaccgagttcggcccgtccgtccggtcgacgttcgttcggaacccgtaagggttacccgaagggttcggaactagttccgaagttacggtaacctggtcggctcggactaaccgttnttccg

SEQ ID NO: 306861 - DNA, 550 bp, Homo sapiens
  misc_feature: GZ8MTXP01BGAIK.3.77.G11.1.454.CMB.2.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacngtctccctctcctgcagggccagtcagagtgtcaacaacaacttagcctggtatcaacagaaacctggccaggctcccaggctcctcatctatgatgtgtcttcgtcgggtcacgtggtcctcccgaggcaggttcaggtggcagtggatcgngggcagtaattcacgctcacatcatcaggctggcggtcngacgtcttcgctagtcttatttcgngtacaacgtagtaccgngtcggcccgtctccggtggactcggttccggaacctaaagggttcccaaaggggttcgaaactagttccgaaggaccgtaacgttgaacgggtctggacccaacgttgttccg

SEQ ID NO: 306862 - DNA, 551 bp, Homo sapiens
  misc_feature: GZ8MTXP01AOMGT.3.77.G11.1.454.CMB.2.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (443)..(443): a, c, t, g, unknown or other
  misc_feature (443)..(443): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacngtcctccctctcctgcagggccagtcagagtgtacaaacaacaacttagcctggtatcaaacagaaacctggaccaggcctccaggctcctnatctatgattgtgttcttcgtcgggtcacgttcggtcctcccgaggctaggttcagtggcaggtgatcgtgggaacagtaatcacgctcacatcatcgaggctgcgtctgacgtctcgctagtcttatttcgagtcaactagttacgngtcggcccggtcctccggtggtacctacgttccgggaacctaaagggttacccgaagggttcgaacctgttccgaggacgtaacgtgtcggctcgccaaccgttgttc

SEQ ID NO: 306863 - DNA, 555 bp, Homo sapiens
  misc_feature: GZ8MTXP01AIXTZ.3.77.G11.1.454.CMB.2.raw
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
  modified_base (419)..(419): a, c, t, g, unknown or other
  misc_feature (419)..(419): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaacctggccaggctccaggctcctnatctatgatgtntcttcgtcgggtcacgtggtctcccgaggcaggttcagtggcagtggntcgtgggcagaattcacgctcacatcatcaggctggcgtctgacgtacttcgctaggttccttagtttccngttacaacagtacgagtcggccggtcctcggtgggactacgttccgggcctaaagggttacccgaagggttcggaacctagttccgacgaccggtaaactgggtaacgggcttcggacctaacccgttaagttccg

SEQ ID NO: 306864 - DNA, 509 bp, Homo sapiens
  misc_feature: GZ8MTXP01D1DPW.3.77.G11.1.454.CMB.2.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtctccctctcctgcagggccagtcagagtgtcaacaacaacttagcctaggtatcaacagaaacctggccaggctcccagctctcatctatgatgtgtcttctcgggtcactggtctccgaggagttcagtgcagtgatcgtagggacngaattcacgctcacatcatcaggtctgcgtctagacgtacttcgctagtcttatttcctgggtacaagtagttacgagtcggccgtcctcggtgactagttcggcctaaaggtccaaggtcgacagtcagcaactgtaggctgcacctgttcgttcg

SEQ ID NO: 306865 - DNA, 500 bp, Homo sapiens
  misc_feature: GZ8MTXP01A9WSS.3.77.G11.1.454.CMB.2.raw
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagagacgcactccacgaccggtgctcgatttagctagtcactcaagggaaagggaggaactgctcagttaggacccagacggaaccatggaagccccagcgcagcttctcttcctcctgctactctggctcccagataccactgcacaaatagtgatgacgcagtctccagccaccctgtctgtttctccagggaaacagtctccctctcctgcagggccagtcagagtgtacaacaacaacttagcctaggtatcaacagaaacctggccaggctcccagctcctcatctatgatgtgtcttcgtcgggtcacgtggtctcccaggcaggttcagtggcagtggatcgtggggcagaattcacgctcacatcatcaggctgcggtctgacacttcgntagtctatttcngtcaacngtacgnttcggccgcctcgtggacagttcggccaaggttccaagggttgacattcgagacgaatgtgctgctaaccttgtc

SEQ ID NO: 306866 - DNA, 568 bp, Homo sapiens
  misc_feature: GZ8MTXP01AD7QE.3.77.G11.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
  modified_base (563)..(563): a, c, t, g, unknown or other
  misc_feature (563)..(563): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaattagtgatgacgcagtctccagccacctgtctgttctccgagggaaacngtctccctntctgcagggccaggtcagagtgtcaacaacaacttagcctggtatcgaacagaaactggccaggctcccaggctcctgactctaagtgactggtgtcttgtcgggtcacttggtcctcccgtaggtctagggtttcaagggttcggctaagggttggaattccgtaggggaacctaggtaaattccgacgtcttcaccatcatcaggctgcgtcngacgtacttcgctagtctattcggtntaccgatagtacgagtggccggcctccgtggactacgtccggtcctaaagggttaccaaagggttcgaactacgttccgaggacgaacgtgtaacgggctcggacaaccgnttccg

SEQ ID NO: 306867 - DNA, 535 bp, Homo sapiens
  misc_feature: GZ8MTXP01AEYBP.3.77.G11.1.454.CMB.2.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (407)..(407): a, c, t, g, unknown or other
  misc_feature (407)..(407): n is a, c, g, or t
  modified_base (530)..(530): a, c, t, g, unknown or other
  misc_feature (530)..(530): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtcctccctctcctgcagggccagtcagagtgtcaaacaacaacttagcctggtatcaaacgagaaacctggccaggctcccagctctcatcatgatgtgtcttcgtcgggtcacgtggtctcccgaggcaggttcagtgcagtgatcgngggaacngaattcacgctacaccatcgatcagggtctgcggtctgacgtactcgntagtcttatttcgtagtcaaacctagtaccgatcgggccgacctccggtggactacgttcggaaccaaggttacccgaagggttcgactaattcgaagacgaactggtgcttagcctaaccgnttccg

SEQ ID NO: 306868 - DNA, 561 bp, Homo sapiens
  misc_feature: GZ8MTXP01D7UVU.3.77.G11.1.454.CMB.2.raw
  modified_base (340)..(340): a, c, t, g, unknown or other
  misc_feature (340)..(340): n is a, c, g, or t
  modified_base (413)..(413): a, c, t, g, unknown or other
  misc_feature (413)..(413): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtctccctctcctgcagggccagtcagagtgtcaacaacaacttagcctggtatcaacagaaacctggccaggctcccaggctcctcatctatgatgtgtcttctcgggtcactggtctccaggcaggttcagtggcngtgatcgtgggcagaattcacgctcacatcatcaggctgcggtactgacgtacttcgctagttcctatttcgngttacaacgagttacgagtcggccggccctcggtcggactacgttccgggaaccgtaaaggttacccgaaaggggttcggaaacctattaccggaaggaacccgtaaagtgggtcgggtcttaggaccctaacccgttaagtttcccg

SEQ ID NO: 306869 - DNA, 562 bp, Homo sapiens
  misc_feature: GZ8MTXP01AP41I.3.77.G11.1.454.CMB.2.raw
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
  modified_base (504)..(504): a, c, t, g, unknown or other
  misc_feature (504)..(504): n is a, c, g, or t
  modified_base (556)..(556): a, c, t, g, unknown or other
  misc_feature (556)..(556): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccagggaaacagtctccctctcctgcagggccagtcagagtgtacaaacaactaacttagcctggtatacaacagaacctggccaggctccagctctcatctatgatgtgtcttcgtcgggtcacgttggtcctcccgaggctaggttcaggtgnagtgatcggngggaacaggaattcgacgctacacntcatcgaggctggccggtactgaccgtcttcgctagttcttagttcgtagacaacgtagtacgcgtcggcccgtccgtcggtcggactacggttccggaacctaaacgggttcaaacgggggntaaccgaattacggaagttaccggtaacgtgggtcgctacgacctaacgttntttccg

SEQ ID NO: 306870 - DNA, 551 bp, Homo sapiens
  misc_feature: GZ8MTXP01CB5S8.3.77.G11.1.454.CMB.2.raw
  modified_base (201)..(201): a, c, t, g, unknown or other
  misc_feature (201)..(201): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcaacaaatagtgatgacgcagtctccagccaccctgtctgttctccagggaacngtctccctctcctgcagggccagtcagagtgtacaaacaactaacttagcccttaggtatacaaacacgaaaccgtggacccaggcctacccgaggcctcctcaatctatgtactgtcgtcttcgtcgggtctacgtgtctccgagctaggtcaggtggcagtggatcgtgggaactaggaacttcgagcctacacatcntcgagctgcgtntgacgtcttcgntacgttntactttcngtacgactaggtcacgtcgggccggtaccgtccgtaggactcggttccgggaaccaaggttacccgaagggttcgaactnacgngaacgngtgaagtcngctaacttgttc

SEQ ID NO: 306871 - DNA, 625 bp, Homo sapiens
  misc_feature: GZ8MTXP01ACBXS.3.77.G11.1.454.CMB.2.raw
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggcctcccagataccactgcacaaatagtgatgacgcagtctccagccacctgtatgttctcgagggaacagtctccctntcctgcagggccagtcagagtgacaaacaactacttagcctaggtatcaaacagaactggccaggctccgaggctccanatctangtatgtnttctgtcggtcacgtggtcctccgagtctaggtcagtgcagtcggatcgtagggaacagtaacttcgacgctacacctaatccagtcgaaggtccgtgtcggtactaggaccgtacgttccgacgtaagttcttaacgtttcgtacgttaccgaacgtacgtacgtacgtcgggccccgtacgttccgggagtaccgtacggtttcccgggaaaccgtaagggttaaaccccggtaagggcgaaacccgtaagttacccggaaacggttacgtttaaaacccgggtggtaaccggtacctcggaacctaaccgttaacgtttcg

SEQ ID NO: 306872 - DNA, 548 bp, Homo sapiens
  misc_feature: GZ8MTXP02JBK0K.3.77.G11.1.454.CMB.2.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccagggaacngtctccctctcctgcagggccagtcagagtgtacaacaacaacttagcctggtatcaacagaaacctggccaggctcccaggctcctcatctatgatgtgttcttcgtcgggtcacgttggtctcccgaggcaggttcagtggcagtggatcgngggacagtaattcacgctacaccatcatcaggctgcggtctgactacttcgctagttctatttcgngtaccaaacgtagttaccgagttcgggcccggtccttccggngacctgtttcccggggacctaaagggttacccgaaagggtcggactagtaccgagaaccgaagtggtcggctagccacatttccg

SEQ ID NO: 306873 - DNA, 502 bp, Homo sapiens
  misc_feature: GZ8MTXP02JWXXH.3.77.G11.1.454.CMB.2.raw
tcagagacgcactccacgaccggtgctcgatttagctagtcactcaagggaaagggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgcatccaacagggcccatggcatcccagccaggtcagtgcagtggtctggggacaggacttcactctcaccatcagcagcctagagcctgaagattttgctagtttattactgtcagcagcgtaagcaactggcctctcaccgttcggcggagggaccaaagggtcggagactacgaaagaacgtgtcggactggcaacctatc

SEQ ID NO: 306874 - DNA, 498 bp, Homo sapiens
  misc_feature: GZ8MTXP02FRWTW.3.77.G11.1.454.CMB.2.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacngtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatcgtgggcagaattcacgctacaccatcatcaggctgcggtcngacgacttcgcagttctatttcngtcaacagtacgatggccgctccgtgacngttcggacaaggtaccaaggtgacngtacagacgaactggtacggctgcaccatcg

SEQ ID NO: 306875 - DNA, 516 bp, Homo sapiens
  misc_feature: GZ8MTXP02H17PD.3.77.G11.1.454.CMB.2.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtctccctctcctgcagggccagtcagagtgtcaacaacaacttagcctggtatcaacagaaacctggccaggctcccaggcctcctcatctatgatgtgtcttctcgggtcactggtctcccaggcaggttcagtggcagtggatcgtgggcagaattcacgctcaccntcatcaggctgcgtctgacgacttcgcagttctatttctgtcaaacngtacgatgggccgtcctcggtggactagttccggactaagggttaccaagggtcggactagtccaagacgaacgtggtggcctggaccaccgtatcg

SEQ ID NO: 306876 - DNA, 517 bp, Homo sapiens
  misc_feature: GZ8MTXP02JOFQO.3.77.G11.1.454.CMB.2.raw
  modified_base (203)..(203): a, c, t, g, unknown or other
  misc_feature (203)..(203): n is a, c, g, or t
  modified_base (412)..(412): a, c, t, g, unknown or other
  misc_feature (412)..(412): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacngtctccctctcctgcagggccagtcagagtgtcaacaacaacttagcctggtatcaacagaaacctggccaggctcccaggctcctcatctatgatgtgtcttctcgggtcactggtctcccagcaggttcagtggcagtggatcgtgggacagaattcacgctcaccatcatcaggctgcgtctgacgtacttcgcagttctatttcngtacaactagtacgagtcggcccgtcgtccgtggactagttccggacaaaggtaccaaagggtcggaacagtacagacgaacgtggacggctgaccacctatccg

SEQ ID NO: 306877 - DNA, 505 bp, Homo sapiens
  misc_feature: GZ8MTXP02J3KIQ.3.77.G11.1.454.CMB.2.raw
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggcccaggcctcccaggcctcctcatctatgatgcatcccaccaggggcccaccggtancccagccaggttccagtggcaggtgggtctggggcagagttcactcncaccatcagcagcctgcagtctgaggtattttgctagtttattactgtcagctattacaataactgcccgtgctcacgtttcggcggagggaccgaaggtgagatacaaacgaacgtgtgctgcacatcg

SEQ ID NO: 306878 - DNA, 559 bp, Homo sapiens
  misc_feature: GZ8MTXP02GVWUR.3.77.G11.1.454.CMB.2.raw
  modified_base (393)..(393): a, c, t, g, unknown or other
  misc_feature (393)..(393): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcacgtggtctcccgaggcaggttcagtggcaggtggatcgtgggcagaattcacgtctcaccatcatcaggctggcgtcngacgacttcgcagtcttatttctgttcaaactagtacgagtcgggcccggtccgttacccggtggaacctacgttacccggggaccctaaacgggttacccgaaagggtcggaaactacgtacgaagaccggtaagtcggtagggacctgaccacccgtagttccg

SEQ ID NO: 306879 - DNA, 527 bp, Homo sapiens
  misc_feature: GZ8MTXP02HD9RY.3.77.G11.1.454.CMB.2.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgttctccagggaacngtctcctctcctgcagggccagtcagagtgtcaacaacaacttagcctggtatcaacagaaacctggccaggctcccaggcctccncatctatgatgtgtcttctcgggtcacgtggtcctcccaggcaggttcaggtgcagtggatcgtggggcagtaattcgacgctcaccatcatccaggctgcgttngacgacttcgcagttctatttcngtacaactagtacgagtcggccgcctcggtggacctagttcccgggacaaacgggtacccaagggtcggaacacgtaccaggaaccgaacgtggtacggctggaccactatcg

SEQ ID NO: 306880 - DNA, 501 bp, Homo sapiens
  misc_feature: GZ8MTXP02IJBIM.3.77.G11.1.454.CMB.2.raw
  modified_base (286)..(286): a, c, t, g, unknown or other
  misc_feature (286)..(286): n is a, c, g, or t
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccacctgtctgtttctccaggggaacagtctccctctcctgcagggccagtcaaagtgtcaacaacaacttagcctggtatcaacagaaactggccaggctccaggctcctnatctatgatgtgtcttcgtcggtcacgtggtctccaggcaggtcagtcgcagtggatcgtgggacagaattcacgctacacatcatcagtctgcggtcngacgattcgcagtctatttcngtcaangtanatggccgtctcggtgactagtcggacaacggtacaaaggtcgaacatcgaacgtacgaacgtgtcggactcgacaccagttctcg

SEQ ID NO: 306881 - DNA, 534 bp, Homo sapiens
  misc_feature: GZ8MTXP02FUFFC.3.77.G11.1.454.CMB.2.raw
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtctccctctcctgcagggccagtcagagtgtacaacaacaacttagcctggtatcaacagaaacctggaccaggctcccaggctcctcatctatgatgtntcttctcgggtcactggtctcccaggcaggttcagtgcagtggatcgtgggcagaattcacgctcaccatcatcaggctgcgtntgacgacttcgctagtccttagtttctgtacaacaggttacgacgtgggcccgtccgtaccgtggactagttccgggacctaaaaggggtcccaaagggttcggactacgtcaaggacgtaacgtggtacggactgacaccgattcg

SEQ ID NO: 306882 - DNA, 600 bp, Homo sapiens
  misc_feature: GZ8MTXP02JRK56.3.77.G11.1.454.CMB.2.raw
tcagagacgcactccacgaccggtgctcgatttagctagtcactcaagggaaaggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccgaggcctcctcatctatgatgcatccacgagggcccacggtatcccagccaggttcccaggtggcaggtcgggtctggggacaggtagttccactctcaccatcagcacgcctgcagtcgtggtaggtattttgacttaagtttatttacgtgttacagtactaattaacaagttaacgtcggtaccgtcggtccttacgtacggtttccggggacgggtacggggtaacccgtaaagggggttacggaacggtaacgtaaccgaaaacggtaacgttcgggttacgggacttcgggaccctaacccgttacgtttccg

SEQ ID NO: 306883 - DNA, 523 bp, Homo sapiens
  misc_feature: GZ8MTXP02F8DTB.3.77.G11.1.454.CMB.2.raw
  modified_base (413)..(413): a, c, t, g, unknown or other
  misc_feature (413)..(413): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggcctcctcatctatgatgtgtcttctcgggtcactggtcctcccaggcaggttcagtggcagtggatcgtgggacagaattcacgctcaccatcatcagctgcgtctgacgcttcgcagttctagtttcngttcaaactagtacgatggctggccctccgtggacagttcggacctaaggttaccaaagggttcggactactcgaaggaacgaaacgttggacggcttacgaccacctag

SEQ ID NO: 306884 - DNA, 551 bp, Homo sapiens
  misc_feature: GZ8MTXP02GUNCV.3.77.G11.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacngtctccctctcctgcaggccagtcagagtgtcaacaacaacttagcctggtatcaacagaacctggccaggctcccaggctcctcatctangatgtntcttctcgggtcactggtctccaggcaggttcagtgcagtgatgtgggcagaattcgacgctacaccatcatcgaggctgcggtctgacgtacttcgctagttcttatttctgttacaagtagtacagttcgggcccggtcctccggtggacctagttcccgggaacctaaggggtaccctaaggggtacggactaacgtcgaacggtaacgaaacgttggtacggcttacggacctaacctacgtttccg

SEQ ID NO: 306885 - DNA, 559 bp, Homo sapiens
  misc_feature: GZ8MTXP02I8G2T.3.77.G11.1.454.CMB.2.raw
  modified_base (396)..(396): a, c, t, g, unknown or other
  misc_feature (396)..(396): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgccagggccagtcagagtgtcaacaacaacttagcctggtatcaacagaaacctggccaggcctcccaggctcctcatctatgatgtgtcttcgtcgggtcacgtggtcctcccgaggcaggttcaggtggcagtggatcgtgggcaggaattcacgctcaccatcatcaggctgcgtcngacgtacttcgactagttcctatttctgttacaaacgtagttaacgagtcgggcccggtcctacccggtggacctagttcccgggaccgaaacggttacccaaagggtggaactacgtaccgaagaaccgaaacgtggtacggctggccctaacgtacttccg

SEQ ID NO: 306886 - DNA, 536 bp, Homo sapiens
  misc_feature: GZ8MTXP02I63HH.3.77.G11.1.454.CMB.2.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtcctccctctcctgcagggccagtcagagtgtcaaacaacaacttagcctggtatcaaacagaaacctggaccaggcctcccaggcctcctcatctatgatgtgtcttcgtcgggtctacgtggtcctcccgaggctaggttcagtgcagtggatcgngggacagacttcacgctacacatcatcgagctggcgtntcgactcttcgctagttcttatttcngtacaacgtagtacgagtcggccgtccgtcggtgactacgttccggaaccgtaaggtaccgaagggtcgaacagtacgaagacgaacgtggtcggctagaccaccattccg

SEQ ID NO: 306887 - DNA, 534 bp, Homo sapiens
  misc_feature: GZ8MTXP02HQQAQ.3.77.G11.1.454.CMB.2.raw
  modified_base (232)..(232): a, c, t, g, unknown or other
  misc_feature (232)..(232): n is a, c, g, or t
  modified_base (392)..(392): a, c, t, g, unknown or other
  misc_feature (392)..(392): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagcccaccctgtctgtttctccaggggaaacagtctccctctcctgcagggccagtcagngtgtcaacaacaacttagcctggtatcaacagaaacctggccaggctcccaggctcctcatctatgatgtgtcttcgcgggtcacttggtctccgaggcaggttcagtggcagtggatcgtgggcagaattcgacgctacgaccatcatcagctgcgtcngacgcttgctagtcttatttctgtacaacagtacgatcggccgtccgtcgtaggactagttccggaccgtaaagggttacccaaagggtcggaactacgtacgaagacgaaacgtggtacggactggacctacgactttccg

SEQ ID NO: 306888 - DNA, 514 bp, Homo sapiens
  misc_feature: GZ8MTXP02GYDFS.3.77.G11.1.454.CMB.2.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (485)..(485): a, c, t, g, unknown or other
  misc_feature (485)..(485): n is a, c, g, or t
  modified_base (504)..(504): a, c, t, g, unknown or other
  misc_feature (504)..(504): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagcccaccctgtctgtttctccaggggaaacngtctccctctcctgcagggccagtcagagtgtcaacaacaacttagcctggtatcaacagaaacctggccaggcctcccaggcctccncatctatgatgtgtcttcgtcgggtcacgtggtcctcccgaggctaggttcagtgctagtggatcgtgggacagtaattcgacgtctacaccatcatcgagctggcgtctcggacgtacttcgctagttcttatttctgtacaacgtagtacgatcggccgcctcgngacngtcggacaaggaccaggtgacngtcgagacgaagtgcgtcngacacgactc

SEQ ID NO: 306889 - DNA, 625 bp, Homo sapiens
  misc_feature: GZ8MTXP02HLVMC.3.77.G11.1.454.CMB.2.raw
  modified_base (307)..(307): a, c, t, g, unknown or other
  misc_feature (307)..(307): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagcccaccctgtctgttctccaggggaacagtctccctctcctgcagggccagtcagagtgtacaacaacaacttagcctggtaatcaacagaaacctggaccaggcctcccgaggcctcctcatctatgatgtntcttcgtcgggtctacgtcggtctcccgaggcgtaggttcaggtggctaggtggatcgtaggggacagtaacttcaccgtctcaccatccagctagcctgactagtcgtggtaagttctttgagtttaagtttactttacgtggtttacagtaccttaaattaaccgaaagttaacgtcgggtaccctcgggttactacgttacccggtttacgggacggggtaacgggtaaaccgtaagggggttacggaacgtacgttaaaccgaaaacggtaacgttaggtacggtacgtacgacccgtaaccgttacgtttccg

SEQ ID NO: 306890 - DNA, 582 bp, Homo sapiens
  misc_feature: GZ8MTXP02GSM0C.3.77.G11.1.454.CMB.2.raw
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtctccctctcctgcagggccagtcagagtgtacaacaacaacttagcctggtatcaacagaaacctggaccaggcctcccaggctcctcatctatgatgtgttcttcgtcgggtctacgtggtcctcccgaggctaggttcagtggctagtggatcgtgggacagtaattccacgctacaccatcatcgaggctggcgtgacgacgtacttcgactagttcttatttctagtacaaacgtaggtacgagtcgggacccgtccgtacggtacggacgtacgttccgggaacctaacgggtaaccgtaacgggtcgaaccgtacgtaccgaacggtaccggaacgttgggttaaccggcttcggacctaccgtatttcccg

SEQ ID NO: 306891 - DNA, 490 bp, Homo sapiens
  misc_feature: GZ8MTXP02FIJU5.3.77.G11.1.454.CMB.2.raw
  modified_base (212)..(212): a, c, t, g, unknown or other
  misc_feature (212)..(212): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctntcctgcagggccagtcagagtgtcaacaacaacttagcctggtatcaacagaaacctggccaggctcccaggctcctcatctaatgatgtgtcttctcgggtcactggtctcccaggcaggttcagtggcagtggatctggggcagaaattcacgctcaccatcatcagctgcggtctgacgacttcgcagtctattctgtcaacagtacgatggcgctcgtggacattcggcaaaggtccaaaggtggacatcagacgaagtgtaggctgcaccatc

SEQ ID NO: 306892 - DNA, 530 bp, Homo sapiens
  misc_feature: GZ8MTXP02F35HE.3.77.G11.1.454.CMB.2.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (527)..(527): a, c, t, g, unknown or other
  misc_feature (527)..(527): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttcnccgaggggaaacngtctccctctcctgcagggccagtcagagtgtacaacaacaacttagcctggtatacaacagaaacctggccaggcctcccaggcctcctcatctatgatgtgtcttcgtcgggtcacgtcggtctcccgaggctaggttcagtgcagtggatcgtgggcagattcacgctcacntcatcgagctggcgtcngacgtacttcgacgtagttcttatttcgtcgtactaacagtacgagtcggccgtccgtcgtggactgttcgacgtaaaggtccaaggtcgactacgtacgaaggtacgaacgtggcgtctcgctaaccgtntcg

SEQ ID NO: 306893 - DNA, 561 bp, Homo sapiens
  misc_feature: GZ8MTXP02GUYJ8.3.77.G11.1.454.CMB.2.raw
  modified_base (202)..(202): a, c, t, g, unknown or other
  misc_feature (202)..(202): n is a, c, g, or t
  modified_base (426)..(426): a, c, t, g, unknown or other
  misc_feature (426)..(426): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtctccctctcctgcagggccagtcagagtgtcaacaacaacttagcctggtatcaacagaaacctggccaggcctcccaggctcctcatctatgatgtgtcttcgtcgggtcacgttggtcctcccgaggtcaggttcaggtggctaggtggatcgtgggacagtaatcacgctacacatcatcgaggctggcgtctgacgtacttcgctagttcttatttcngttacaacgtagtaccgagtcggcccggtcctcggtgaacctagttccggaactaaacgggttaccaaaggggttcggaactacgtaccgaagtaaccgaacgttggacggctacggaccctaaccgatttcccg

SEQ ID NO: 306894 - DNA, 539 bp, Homo sapiens
  misc_feature: GZ8MTXP02F516D.3.77.G11.1.454.CMB.2.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (393)..(393): a, c, t, g, unknown or other
  misc_feature (393)..(393): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtctccctctcctgcagggccagtcagagtgtcaacaacacttagcctggtatcaacagaaacctggaccaggcctcccaggcctcctcatctatgatgtntcttcgtcgggtcactggtctcccaggctaggttcaggtgcagtggatcgtgggcagaattcacgctacaccatcatcaggctgcggtcngacgacttcgacagttcttatttcagtacaacaggttacgacgtgggcccgtcctccgtggaactcgttccgggacctaaagggtacccaagggtcgaacctataccgaggaaccgaacgttgaggcctaggccaacctgtttccc

SEQ ID NO: 306895 - DNA, 624 bp, Homo sapiens
  misc_feature: GZ8MTXP02GK2XI.3.77.G11.1.454.CMB.2.raw
  modified_base (617)..(617): a, c, t, g, unknown or other
  misc_feature (617)..(617): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtctccctctcctgcagggccagtcagagtgtcaacaacaacttagcctaggtatacaacagaaacctggaccaggcctcccgaggcctcctcatctatgatgtgtcttcgtcgggtcacgtcggtcctcccgaggtctagggtttcaggtggactaggtggactcgtagggacgagtaacttcgacgcctacgacctatcagtccgagtcgtggccgttctacggacgtaacctttcgctagttctttactttcgtcgtactaacgtacggttacgacggttcgggacccggtcccgtccgggtagaccgttagttcccggaaccgtaaacggggttacccgaaaggggttcccgaaacgtacgtaccgaaacgggtaacgtaacgtttggacggtaccacggacccaacggtntttcccg

SEQ ID NO: 306896 - DNA, 555 bp, Homo sapiens
  misc_feature: GZ8MTXP02FZY5P.3.77.G11.1.454.CMB.2.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (513)..(513): a, c, t, g, unknown or other
  misc_feature (513)..(513): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttcnccgagggaaanagccactctctcctgcagggccagtcagagtgtagcagctacttagcctggtaccagcagaaacctggccaggctccaggctcctctatttatgatgcatccaacgaggggccacgtggccatccccagcccccaggttccagtggctaggtgggtcgtggggactagtacttcactctcaccatcagcagcctagcgacctagaagtatttgacttagtttacttactgtacagcgtagacgttagcctaagtcggtcctcgtacctaccggttcgggacggaacgggaccgtaaagggtcggaacgtanaaccgaaaacgtaacgtggtacggcctaggccctaacgtacg

SEQ ID NO: 306897 - DNA, 679 bp, Homo sapiens
  misc_feature: GZ8MTXP02JI07B.3.77.G11.1.454.CMB.2.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (468)..(468): a, c, t, g, unknown or other
  misc_feature (468)..(468): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttcnccagggaacngtctcctctctgcaggccagtcagagtgtacaaacaactaacttagcctaggtactacaaactaacgaaacctcggaccaagggtcctaccccgaaggtccttcccctactaacttaccttaagtcgtaagttggtcgttccgttcggttcggggtacctacggttcgggttaccctccccggaaggtccgtaaggtttccgaaggttcggactaggtcggtactccggtaaggggactaaggtaacttcgaaccgctacaccttanactatcgacggtctcggtacgtcgtacgactcgtacgacgttagttcttactttacgtaagtaccgtaacgtacgggtacgtccggtaccgggtacccgtcgtacggacggtaccgtacggtaccgggaaacgttaacggtaacggtaaacggcgaacgtacgtaaacgtacggtaacgtaacgtgggacgtcgtaccacgtactcgttac

SEQ ID NO: 306898 - DNA, 592 bp, Homo sapiens
  misc_feature: GZ8MTXP02HV6ST.3.77.G11.1.454.CMB.2.raw
  modified_base (464)..(464): a, c, t, g, unknown or other
  misc_feature (464)..(464): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaacagtctccctctcctgcagggccagtcagagtgtacaaacaacaacttagcctaggtatacaaacagaaacctggaccaggcctacccaggcctcctcatctatgatgtgtcttcgtcgggttcacgttcggtcctcccgaggcgtacggttcaggtgcgaggtggatcgtagggacaggtaattccgacgtcctaccacctataccatccgtacgggctcgggcgttcgtacggacgtacgtccggtctagtcctttatttcngtacaacgtagtaccgagtccggccgtccgtcggtagacgtacgttaccggaccgtaaagggtacccgaaagggtcggaaccacgtacgaacgacgtaacgtgggtacggcacgtaccacgtacttcg

SEQ ID NO: 306899 - DNA, 524 bp, Homo sapiens
  misc_feature: GZ8MTXP02I0GKN.3.77.G11.1.454.CMB.2.raw
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
  modified_base (449)..(449): a, c, t, g, unknown or other
  misc_feature (449)..(449): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagcccaccctgtctgttctccaggggaacagtctccctctcctgcagggccagtcagagtgtcaacaacaacttagcctggtatcaacagaaacctggccaggctcccaggtcctcctcatctatgatgtgtctttcgtcgggtcacttggtcctccccgaggcaggttcagtggcagtggatcgtgggacagaattcacgctcacntcatcaggctgcgtctgacacttcgctagttctatttcngttcaactgtacagtcgggaccgcgtccggnggactagttccgggactaaggtaccgaagggtcggactagtacgagaacggaactggacggactgcctacatttc

SEQ ID NO: 306900 - DNA, 608 bp, Homo sapiens
  misc_feature: GZ8MTXP02HE9M0.3.77.G11.1.454.CMB.2.raw
  modified_base (199)..(199): a, c, t, g, unknown or other
  misc_feature (199)..(199): n is a, c, g, or t
  modified_base (326)..(326): a, c, t, g, unknown or other
  misc_feature (326)..(326): n is a, c, g, or t
  modified_base (604)..(604): a, c, t, g, unknown or other
  misc_feature (604)..(604): n is a, c, g, or t
tcagagacgcactccacgaccggtgctcgatttagctagtcactcaagggaaagggggaggaactgctcagttaggacccagacggaaccatggaagccccagcgcagcttctcttcctcctgctactctggctcccagataccactgcacaaatagtgatgacgcagtctccagccacctgtctgttctcagggaacngtctcctctcctgcagggccagtcagagtgtcaaacaacaacttgcctggtatacaactagaaacctggaccacggcctcccgaggcctcctcatctatgatgtgtcttcgtcggtctacgtgtccnccgaggctaggttcacgtgcaggtgatcgtagggacagtaacttcacgtctacaccagtacacgtcaggtcgtggtccgtctcggaccgtacgttcgccgtagttactttacttttcgcggtttaaccaaacttagggtaccgtaggttccgggaccccggttccgttaccccggtagtaaccgtacgttcccggggaaacgtaaaccggggtacgaaaacgggttcgaaacctcgtaacgacgacggtaaactcggtacggctacggaccaacgttntccg

SEQ ID NO: 306901 - DNA, 601 bp, Homo sapiens
  misc_feature: GZ8MTXP02F9HF1.3.77.G11.1.454.CMB.2.raw
  modified_base (460)..(460): a, c, t, g, unknown or other
  misc_feature (460)..(460): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagacgccaccctctcctgcagggccagtcagagtgttgacagcaacgttggcctggtaccagcagccaacctggccaggcctcccgaggcctcctcatctatgatcgccatcccaccgacgggcccaccggtactccccgagccgtaggttcccgagtcggctaggtggggtcctaggggaccagggtacgttccacgtcctacgacccatcagacacgcctgcacgtctggtagtgtttgacttagtttattactgtnagtactaacttaacaacgttacgtcggccgtcggtactcgtaccgtttcgggacgggtaacggaccggaaagggtacggacgtaacgtaaccgtaaaacggtaacgttacggtacggtcgtacggaccaccgtacttaccg

SEQ ID NO: 306902 - DNA, 644 bp, Homo sapiens
  misc_feature: GZ8MTXP02H95HB.3.77.G11.1.454.CMB.2.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (382)..(382): a, c, t, g, unknown or other
  misc_feature (382)..(382): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgttctcagggaacngtctcctctcctgcagggccagtcagagtgtacaacaacaacttagccttggtatcaacagaaacctggaccaggctcccgaggcctcctcatctatgatgtntcttcgtcgggtcactggtcctccccgaggcaggttcacggtgcagtggactcgtagggcagtacttcgacgtctcaccntaccattcgaaggtcttacgggcgttctacgaccgtacgtttccgactaggttcctttaatttccgtcgtaccaaacgtacgtaacgacgttcggggacccggtccgttaccggtggtaacctacgtttaccccgggaaccgttaaaaccgggggttaaccccgaaaggggttaccgggaaacctacgttaaccgaaccgggttaaccgaaacggttacggggttcggaccgttacggaccccgtaaacctacgtttcccgg

SEQ ID NO: 306903 - DNA, 569 bp, Homo sapiens
  misc_feature: GZ8MTXP02HSV0Q.3.77.G11.1.454.CMB.2.raw
  modified_base (447)..(447): a, c, t, g, unknown or other
  misc_feature (447)..(447): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaaacagaaacctggaccaggcctcccgaggcctcctcatctatgtatgtgtcttcgtcgggtcacgttggtcctcccgaggtcctaggttcaggttgctaggtcggtatcgtaggggctaagtaattccacgtcctacactatcaatcaggctggcgttctaggacgtacttcgctagttcttatttcngttacaacgtagtacgagtcggccggtcctcgtaggactcgttaccggacctaaagggttaccaagggtcggaaactgtaccgaagaacgtaacgtggtacggtctacgccaaaccttctcg

SEQ ID NO: 306904 - DNA, 699 bp, Homo sapiens
  misc_feature: GZ8MTXP02GBM9C.3.77.G11.1.454.CMB.2.raw
  modified_base (192)..(192): a, c, t, g, unknown or other
  misc_feature (192)..(192): n is a, c, g, or t
tcagagacgcactccacgaccggtgctcgatttagctagtcactcaagggaaagggggaggaactgctcagttaggacccagacggaaccatggaagccccagcgcagcttctcttcctcctgctactctggctcccagataccactgcacaaatagtgatgacgcagtctccagccaccctgtctgtttcnccgagggaacagtctccctctcctgcgagggccagtcagagtgtacaaacaactaacttagcctggtatacaacaagaaacctggaccacggcctacccaggcctacctcactctaatgtatgtcgttcctttcggtcgggtctacgttcggtcctaccccgaggtcgtaacggtttcagggtacggctaaggtcggtattccggtaggggacctaaggtaacttaccgaaccgtccgttaccaaaccctattaaccctagtaccgtaacggggtccgttacgggtcccggggttactccggggaaaccctttacccggtttaccgacgttacgtttacctttaactttccgtaggttaaccccctaaaggttacggttaaccgcggttccggggcccgtaccgttacggacggtacctacgttccgggaacccgtaacgggtaccgaaacgggttacgaccgtatacggaacgtacgtaagtcggtacgctacgactacctattcg

SEQ ID NO: 306905 - DNA, 601 bp, Homo sapiens
  misc_feature: GZ8MTXP02IEPJY.3.77.G11.1.454.CMB.2.raw
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctcaggggaacagtctcctctcctgcagggccagtcaaagtgtacaacaacaacttagcctggtatcaacagaaacctggccaggctcccaggcctcctcatctatgatgtgtcttcgtggtcactggtctcccgaggcaggttcaggtcgcagtgatcgtgggacngaacttcacgctacacatcatnaggctgcggtcngaccgtacttcgctacgttcttatttccgtagtacctaacgtacggtacgacgttccggggcccggtcccgttacggtacggaaccttacggtttacccgggaacccgttaaaacggggtacccgtaaaggggttcggaaacctaacgtccgaaaaccggtacgtaaaacgtggtacggacgttcggacctaccgtacgtttcggtttccg

SEQ ID NO: 306906 - DNA, 573 bp, Homo sapiens
  misc_feature: GZ8MTXP02FH7CU.3.77.G11.1.454.CMB.2.raw
  modified_base (202)..(202): a, c, t, g, unknown or other
  misc_feature (202)..(202): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
tcagagacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccagggaaacngtctccctctcctgcagggccagtcagagtgtacaacaacaacttagcctaggtatcaacagaaacctgaccaggctccaggctcctcatctatgatgtgtcttcgtcgggtcacgtggtctcccgtagctaggttcaggtcggcaggtggatcgngggtacagaattcgacgtctcaaccntcatccgaggtcctggcgtcncgaccgaccttcgcgtagtccttagtttctggtacaacgtagtacgacgttcgggcccggtcctttcggcgactacggttcggacccgtaaaggtaccccgtaagggtacgaacgtacgtacgaacggtaaacccgtaagtcggtcggactgccgaccgtagtttccg

SEQ ID NO: 306907 - DNA, 716 bp, Homo sapiens
  misc_feature: GZ8MTXP01EZPBJ.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacagccgtgggggtccctgagactctcctgtgcagcctctggccttccccgttaggagctatcgccatcgaccgtcgggtcccgccgaggcctccgagggggaacggggctcggaggtgggtctcggacaagttggcgctagtcgaccaactgacacaatacgtaacggagagtccggtaggaacgggccgtcttccaccatcctaccagacgaacgtaacgttaccggaaactacgttaactttttaccgtaaggtaaattacgaacgacgtaccgtaggaacggagtacggaaacgaccgtaaccgggttacccttttaacgtttaccgttgggttcggaaccggggtaaaggggttaacggggggggggtaacgttacggggacgttaccccgacggttacgggttcgggggttgggggttacgggtttaaccggtaaaccggttcccgggttcgggggtaacccgggttaacgggggtaaccccggg

SEQ ID NO: 306908 - DNA, 730 bp, Homo sapiens
  misc_feature: GZ8MTXP01CXCV6.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacgagccgtggggggtccctgagactctcctgtgcacgcctctcggtccttccccgtttaggagctatcgccatcgaccgtcgggtccgccgaggcctccgagggggaacggggctcggaggtgggtctcggactaagttggcgctagtcgacatgacacaatacgaacggagtagtccgtaggaacgggccgtcttacaccactctccagacgaacaaacgttacccggaaactacgttacttttacgaaggtaaacttagaaacgacgtaccttagaacggtacgtaccgaaacgtaaccgtaccgggtaccccttttaagtttcccgtaggttcggaacggggaaacgggggacgggggggggggtaaccgttacggggaaacgttcccggaaccggttaacgggggttcggggggttaagggggttacgggtttaacccggaaacccgggttcccgggggttacggggggtaaccccggaacggggggttaacccccgggg

SEQ ID NO: 306909 - DNA, 753 bp, Homo sapiens
  misc_feature: GZ8MTXP01AMBMZ.44.84.H07.1.454.CMB.2.raw
  modified_base (312)..(312): a, c, t, g, unknown or other
  misc_feature (312)..(312): n is a, c, g, or t
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgactattttaaaaggtgtcagtgtgaggtggcctgtggagtcgtggggaggattggcacagccgtgggggtccctgagactctcctgtgcacgcctctcggtcctttccccgttaggacgctatcgccatcgaccgtcggggtcccnccgaggcctccgaggggaacggggctcggaggtgggtctcggacgtaagttggcgtctagtcgacactgaccacaataccgtaacggagacgtaccggtaggaacggggccgtaccttaccgaccctactcctacccgaagacgaactaaacgtttacccggaaactaccttaacttttaccgtaaggtaaattcgaaacgacgtccgtagaacggacgttacgaacgtaccgtaaccgggttacccttttaagtttccgtggttacgggtaaccggggtaaagggggttacgggggggggggtaaaccgttacgggggtaaccgttaccccgggaacgggttacggggtttacggggggttgggggtttacgggtttaaccggtaaacccgggttcccggggttacggggggaacccggttaaggggggtaaccccgggg

SEQ ID NO: 306910 - DNA, 680 bp, Homo sapiens
  misc_feature: GZ8MTXP01D3GI6.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgactattttaaaaggtgtcagtgtgaggtgcctgttggagtcgtggggagattggcacagccgtgggggtccctgagactctcctgtgcacgtcctcgtcggtcctttccccgtttaggcgctatcgccctaagtcgacccgttcggggtccccgccgacggcctccggaagggggaacggggtctcggaggttcgggtcctacgacgtaagttcggcgcgtagtcgaccaacgtgaaccacgtaaatacgtaacgggagtacggtcccggtaggaacggggcccgtcttaccaccatcctacgagacaactaacgttaccgaaactaccttacttttacgtaggtaaatacgaaacgacgtaccgtagaacgagtacgaaagaccgtaccggtccttttaatttcgtggtggaacgggtaaggggaggggggtacttgggtacgtcgacggttaggttgggggtgggttacggtccgtaacgtccggttacggggccgttaaggggtaacccgg

SEQ ID NO: 306911 - DNA, 564 bp, Homo sapiens
  misc_feature: GZ8MTXP02JNSUZ.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattgggcacagcctggggggtccctgagactctcctgtgcagcctctggcttccccttaggagctatgccatgacctgggtcccgccaggctccgaggggaaggggctcgagtgggtctcgacaattggtgctagtcgcaactgacacatactcggagagtcccgtgaacggggccgcttcgacccagtcctccagacgacaattccggaaacacgtactttcgtagtaaatgaaacagacctgagagtcgaagacgacggtccttattcgtgtgacgaaggaggggggactggactccgacgagtgggtgggtcggtacgacgtcgtcggggccgagggtaccgg

SEQ ID NO: 306912 - DNA, 615 bp, Homo sapiens
  misc_feature: GZ8MTXP02I6NSI.44.84.H07.1.454.CMB.2.raw
tcagacagtatatacacgaccggtgctcgatttagcagacgtctgtcgcggggagctctgagagaggagcccagccctgggattttcaggtgttttcatttggcgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggccttccccttaggagctatgccatcgacctgggtccgccaggctccgaggggaaggggcctcgaggtgggtctcgacaagttggcgctagtgcaactgacacatactacgggagacggtcccggtagaacggggcccgtcgttaccaccctatccctcccaagtacgaactaaacttacccgggaaaactacctaacctttttccgaggtaaaactagaaacacgccgtagagagtacgaagacacggtaccctttattcgtgtgtacgaaggggaggggggactagggacgtaccgacgaggtaggggtggggtcggttacgaccgtcggtcggggccgtaggggccg

SEQ ID NO: 306913 - DNA, 623 bp, Homo sapiens
  misc_feature: GZ8MTXP02JAT8K.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgactattttaaaaggtgtccagtgtgaggtggccctgttggagtctgggggagattggcacagccgtgggggtccctgagactctcctgtgcagccctctggccttccccgtttaggagtcctatgcccatcgaccgtgggtcccgccaggcctccggagggagggctcggagtggtctcgactagttgcgctagcgacaacgtgacacactaccgtacgggagacggtcccgtagaacgggcctcgtaccaccgactcctaccagacgaactaacgttacccggaaactaccttacttttacaggtaaactcgaaacgacgtacctaggtagacgtacgaacgactaccggtcctttatttcgtgttcgacggtaaggggacggggggtactaggacgtcccgaacgtggtaggggtggtcggttacacggtccggtaggggaccgagggtacccgg

SEQ ID NO: 306914 - DNA, 586 bp, Homo sapiens
  misc_feature: GZ8MTXP02IEO2X.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacagccgtggggggtccctggagactctcctgtgcagcctctggcttccccttaggagctatgccatgaccgtgggtcccgccacggctccgaggggaaggggctcggaggtgggtctcggacaagttggcgctagtcgcaactgacacatactacgggagagtccgtgaacggggccgcttccaccatcctaccagagacaacttaccggaaacactacttttacaggaaatacgaacacgcctagagacgtacgaagacgacggtcctttattctgtcgtacggaagggaggggggactaggactccgacgtaggtggggtgggtcggttacgaacgtcggtcggggcgacgggaccgg

SEQ ID NO: 306915 - DNA, 540 bp, Homo sapiens
  misc_feature: GZ8MTXP02GL2BV.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggcttccccttaggagctatgccatgacctgggtccgccaggctccagggaaggggctcgagtgggtctcgacaattggcgctagtgcaactgacacatactacgggagagtcccgtgaaggggccgcttcaccatctccagagacaattccggaaacacacttttctgaaatgaaacagcctgagagtcgaagacacggcccttattctgtgcgaaggaggggggactgggactccacagtgggtgggtggttcaacgtcctggggccagggacg

SEQ ID NO: 306916 - DNA, 633 bp, Homo sapiens
  misc_feature: GZ8MTXP02G3B2A.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggcctgtggagtcgtggggagattggcacagccgtgggggtccctgagactctcctgtgcagcctctggccttccccttaggagctatcgccatcgaccgtggtcccgccaggcctccgaggggaaggggctcggaggtgggtcctcgactaagttggcgctagtcgacaactgacacatacgtacgggagacgtccgtagaacgggccgcttacaccatcctaccagacgaactaattcaaggtaaacaacttacttttacgtacgtaaattacgaaactagaccgtagaagacgtacgaaacgacgtaaccggtacccttttaagtttccgtaggtaggtaccgggaaaggggtacgggggggtactacgggtacgtaccgacgtaagggtggggttgggtacggtacgtaaccgtcggtacggggacgtaacgggg

SEQ ID NO: 306917 - DNA, 585 bp, Homo sapiens
  misc_feature: GZ8MTXP02GMZHE.44.84.H07.1.454.CMB.2.raw
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggcttttcttgtgactattttaaaaggtgtccagtgtgaggtggccctgttggagtcgtgggggaggattggcacagcctgggggtccctgagactctcctgtgcagctctggctccccttaggngctatgccatgacctggtccnccaggctccgagggagggctcgagtggtctcgacaattggcgctagtgcaactgacacatactacggagagtccgtgaaggccgcttcaccatctccagacgacaactaccggaaacacgtactttacgtagtaaagtagaaacacgtacctagacgagtacgaacgacgacggtacctttacttacctgttagcgaagggaaggggggactagggacgtccgaacgacggttggggtaacgggttgggttacgaaacggtccgttcggggacccgacggggtaccgg

SEQ ID NO: 306918 - DNA, 786 bp, Homo sapiens
  misc_feature: GZ8MTXP02I3WHI.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgtactattttaaaaggtgtccagtgtgaggtggccctgttggagtcgtggggaggattggcacagccgtgggggtccctgagactctcctgtgcagcctctggtccttccccgttaggacgctatcgccatcgaccgtcgggtccccgcgacggcgtaccggaaggggaacggggtccgtcggagggttcgggttaccgtcggaacgtaaacgtttcggggccgtcgttaacggtcgaccgtaaacttacggaacctaactaacgttaaaccgtacggggtaacggtaacggttcccgggtaggaaaccggggtccccgtacgtttacccgaaacctacgttcccgtaacccgaaaggaacgaaacctaaaacgtaccccggaaaactaccgtttacttttaccgaagtaaaacgttagaaaccgtagtcccgtaagacggaacgttaaccgaaacgacgtacccggtaccctttttagttaccgtagggttcgtaaccgggaagggggaacggggggtcgtaacgggtacgtcccgaaacgtagggggttaggggttgggggttaccggtttaaccaaaccgggttccggtacgggggaccgtacgggggttaaccccgg

SEQ ID NO: 306919 - DNA, 699 bp, Homo sapiens
  misc_feature: GZ8MTXP02GWTW1.44.84.H07.1.454.CMB.2.raw
  modified_base (282)..(282): a, c, t, g, unknown or other
  misc_feature (282)..(282): n is a, c, g, or t
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggttgaggtggtctttttcttgtgtactattttaaaaggtgtccagtgtgaggtgcctgttggagtcgtggggagattggcacagccgtgggggtccctgagactctcctgtcgcacgcctctcggccttccccttaggngtctatcgccagtcgaccgtcggtcccgaccgaggcctccggaggggaacggggcctcggaggttcggtctacggacaagtttggcgtcgtaaggcaccctaacgtgaacactaagtacgtaacggagtacgttccggaggaacggggtcccgtactttaccaaaccctactacccgtacccaaggtaacaacgtaaaacgttaccggaaaacctacttaacctttttacgaaggtaaaacttacgaaactacgtacccgttaggaagtacggtaacgaaacgaacccgtacggttaccctttaagttccgtagtacgacggtaaagggggacgggggtactacgggactacgacgtacgggtgggtaggttaacggtacaacggttccggtacggggccgtacggggacctcccgg

SEQ ID NO: 306920 - DNA, 919 bp, Homo sapiens
  misc_feature: GZ8MTXP02FJCZN.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgacttaattttaaaaggtgtccagtgtgaggtggcctgttggagtcgtgggggaggattggcacgacggccggtggggggtcccctggacgactctcctgtgcacgtcctcgtcggtccttccccgtttaggacgctactgcccatcgaccgtcggggtcccgccgacggtcctaccgaaggggacggggtctcggaggttcgggtctacgacgtaaagttcggcgtcgttaggtccgacctaaaccgtgaaacctaacgaacgttaaccgtacggggaaggtacggttacccgggtaagggaaaccgggggtccccgtaccgtttacccaacccctaaacgttcccgttaacccgaaacgggaacggtaaaaccctaaaacggtttaacccccgggtaaaaaaccttaaacccgttttaaacccgtttttttaacccgtaaagggttaaaaaccgttacggaaaaacccgtaaccgggtaccccgttaagggaaacgggttaaacggttaacccggaaaaacggtaacccgttaaaccccggggtttaaccccctttttaaggtttaccgtttacggggtaacgggttaaaccggggaaaaggggggtaaaccgggggggggtaacccgttaggggtaaccgtaaccccgtaacggggtaacggggtttaggggggtcggggtttaccgggtttaaccggtaaaacccggtttccccgggtacgggggacccggtaagggggtaacccccggg

SEQ ID NO: 306921 - DNA, 807 bp, Homo sapiens
  misc_feature: GZ8MTXP02HB8SB.44.84.H07.1.454.CMB.2.raw
tcagacagtatatacacgaccggtgctcgatttagcagacgtctgtcgcgggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattgggcacagccgtggggggtccctgagactctcctgtgcagcctctggcttccccttaggagctatgccatcgaccgtgggtccgccaggcctccgaggggaacggggctcggaggtgggtctcggacaatggcgctagtcgcaactgacacatactacgggagaggtccggtagaacggggccgccgtttaccaacccgtactaccctacccgaagaacgaacctaaacgtttacccgggaaaacctaacttaaccgtttttaccgtagggtaaaaattacggaaaaccgtacgtaccccgttagggaaacggtaacggtaacccggaaaacggtaaacccggtaacccggggttaccccctttttaaacgttttccgttacgggtttaacgggaaccgggggtaaaagggggtaacggggggggggggtaaacccgttaagggggtaaaccggttacccggaaccggtaacggggtttaacgggggggttggggggttttaccgggggtttaaaccggttaaacccggttaccccgggggtttacggggggtaccccgggtaaacggggggtaacccccgggg

SEQ ID NO: 306922 - DNA, 821 bp, Homo sapiens
  misc_feature: GZ8MTXP02HLZUQ.44.84.H07.1.454.CMB.2.raw
  modified_base (184)..(184): a, c, t, g, unknown or other
  misc_feature (184)..(184): n is a, c, g, or t
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgtactaattttaaaaggtntccagtgtgaggtggccctgtggagtcgtgggggagattggcacaggccgtgggggtccctggagactctcctgtcgcacgcctcgtcggtcccttccccgtttaggacgtctagtcgaccctagtcgtacccgtcggggtccccgtccgacggtccgtaccggaagggggtaacggggtccgtacggtagggtcggggttccgtaccggaaccgttaagttcggggaccgtacgttaggtcccgacctaaacgtcgaaccacgtacgttacgtaccggggaagtaacggttcccgtagggaaaccggggcccgtacttacccaacccgtaactcccgtacccgaagtacgaaacctaaacgttaacccggaaactaacccgttaactttttaccgaaggtaaaacgtacgaaacctacggtacccgtaggaacggtaacggtaaccgaaacgtacccgtaaccgggtttacccccttttaatttaccggtcggttaaccggaacggggtaaaacgggggtacggggggtaacgtacgggtaccgtaccgtaacgggtaggggttacggggttcggggttacggttaaccggtaacccggttccgggttacgggggacccggttaacggggtcccgg

SEQ ID NO: 306923 - DNA, 739 bp, Homo sapiens
  misc_feature: GZ8MTXP02G7RSL.44.84.H07.1.454.CMB.2.raw
tcagacagtatatacacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgacttaattttaaaaggtgtccagtgtgaggtggccctgtggagtcgtgggggaggattggcacagccgtgggggtccctgagactctcctgtgcagcctctcggccttccccgttaggagtctatcgccagtcgaccgtcgggtcccgccgacggccgtccggaaggggaacggggccgtcggaggtcgggtcctcggactagttggcgtcgtagtcgacaacgtgaccactaattacgtacggagacggtccggtaggaacgggcccgtccttacccgaccgtactcccgtaccgaacggaaacgaacctaaacttaccgaaacggtaaaacctaaccttactttttaaccgtaaggtaaacttaacggaaaccgtacgtacccgttagggaacgaacggttaaccgaaacggtaaccgtaaccggtttacccttttaacgtttcgtacggttacgggacgggaaagggggtacggggggtactacgggaccgttccggaaggttaggggttcgggggttggggttacggtttacccgaaccggttccgggtacgggggaccggaacggggg

SEQ ID NO: 306924 - DNA, 507 bp, Homo sapiens
  misc_feature: GZ8MTXP01CA6VK.3.20.B09.1.454.CMB.2.raw
  modified_base (370)..(370): a, c, t, g, unknown or other
  misc_feature (370)..(370): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctattaaatggtatcagcaacaaaccaggaaacgcccctaaagctcctgatctatgctgaatccatttgcaaagtgggtcccccatcaaggttcagtggcaagtgatcgtgggacagtatttcactctaaccntcagcggtctgctaactgaagtattttagactaactcactactagtacaacagagtagacagcacgcctaacacttacgttcggacggacgggaccgaagggttggagtaatacaaacgaactgttaggcttgaacc

SEQ ID NO: 306925 - DNA, 538 bp, Homo sapiens
  misc_feature: GZ8MTXP01DAJFF.3.20.B09.1.454.CMB.2.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
  modified_base (361)..(361): a, c, t, g, unknown or other
  misc_feature (361)..(361): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (524)..(524): a, c, t, g, unknown or other
  misc_feature (524)..(524): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcatagcgtactatttaaatggtatcagcaacaaaccgagggaaacncccctaaagctcctgatctatgactgaactcctactttgactaaaggtcggggttacccccagtacgaaaggtttcaaggtgggacnggtggaatcgtgggactagatttcactactaacatcagcggtactgacaaccgtagacgtattttagacctaactctaacttactagtaccaagagagtagacacgccacnccctnacttacgttcggacggaaggaccgttaaggngagaanacgaacgtanagttcgcttgaacc

SEQ ID NO: 306926 - DNA, 560 bp, Homo sapiens
  misc_feature: GZ8MTXP01B2VWJ.3.20.B09.1.454.CMB.2.raw
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctcctcaggagtcgggtcaccatatcagtagacacgtccaagagccagttcnccctgaagctgagggctgtgagcgcgcacgacacggccgtgtattaacngtgcgagactggccnaaacagactacggtggcaactcctatgcttttgatatcgtggggtccaaggggacaagtggtcaccgtctcgttcacgccctcctacccgaacgggcccactccgggtcccttcccccgtcggttccaacccctccttcccgaacgacgccaccgtcgtacgggggccacgaacgccggtcccgg

SEQ ID NO: 306927 - DNA, 627 bp, Homo sapiens
  misc_feature: GZ8MTXP01CZFNQ.3.20.B09.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (279)..(279): a, c, t, g, unknown or other
  misc_feature (279)..(279): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatccctcctgtctgcatctgtagganacagagtcacatcacttgccggganaagtcagagcattagcgtacttaatttaaatggtatcagacaacaaaccgagggaaacncccctaaagcctcctgatctatgctagaactcctactttgactaaaggtcggggtacccccatacgtaaggttcaggttcgggactaagggtggtaactcggttaggggactaaggttactttaccaccttacctaaacctactaccgaggtcccggtacttacggacctaaaccgttagtaaacgttacttttacgacctaaacgtacctaaccgttactacgtaacaaacgagtagtacactacgaccaccgcctaactaacgttaccggtttcgggacgggtaacgggaccgaaggggttgaacggtaataaccgaaacgtaacgtggttacgtcgttcgaaccc

SEQ ID NO: 306928 - DNA, 531 bp, Homo sapiens
  misc_feature: GZ8MTXP01A8RWL.3.20.B09.1.454.CMB.2.raw
  modified_base (346)..(346): a, c, t, g, unknown or other
  misc_feature (346)..(346): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcagcccccagggaaggactggagcatattgggtatgtctttcacagtgggaggactgactacaacgcctccctcacggngtcgggtcaccataatcaagtagacacgtccaagagcagttctccctgaagctgagggctgtgagcgccgcagacacggggccgtggtattacngtgcgagactggccgcaacngaactacggttggccaacgtcctattgttccttttgaattatcgtgggggcccaaggggaaccaagtcggg

SEQ ID NO: 306929 - DNA, 534 bp, Homo sapiens
  misc_feature: GZ8MTXP01BCPH1.3.20.B09.1.454.CMB.2.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
  modified_base (448)..(448): a, c, t, g, unknown or other
  misc_feature (448)..(448): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcgtctaatttaaatggtatcagcaacaaaccagggaaacncccctaaagctcctgatctatgctgaactccactttgactaaaggtcggggtacccccatacaaggttcaggtggcgtaagtggatcgtagggactagtactttcactactaaccatcacgcggtctgactaacctgaagtatttcgactaacgtctaacttactcgtacaacngagtacgacagccaccgcctcacttcgttcgggacggacgggaccgagggttgagaactacgaaacgacgtggttagcgttgaacc

SEQ ID NO: 306930 - DNA, 539 bp, Homo sapiens
  misc_feature: GZ8MTXP01A6JT6.3.20.B09.1.454.CMB.2.raw
  modified_base (275)..(275): a, c, t, g, unknown or other
  misc_feature (275)..(275): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcgtctatttaaatggtatcagacaacaaaccgaggaaacncccctaaagctcctgatctatgctgaactccatttgacaaaggtcgggtacccccatcgaaggttcaggtggctaaggtggactcgtaggggacagtatttacactactaaccatcagcgtactcgactaaccgtagtaagtatttacgactaactactacttactacgtacaacgagagtagacagccacgcctaacacttacgttcggcggaacgggacgaagggttggagaatacgaaacgacgtaggcggtcttcgaacc

SEQ ID NO: 306931 - DNA, 552 bp, Homo sapiens
  misc_feature: GZ8MTXP01AMYHS.3.20.B09.1.454.CMB.2.raw
  modified_base (469)..(469): a, c, t, g, unknown or other
  misc_feature (469)..(469): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactgggtgaagccttcggagaccctgtcccctcacctgcactgtctctggtgctccatccgtcttactactggagctggctccggcacgcccccagggaacgggactggagcatattgggtatgtctttcacagtgggagactgactacaacgcctcctcacggagtcggtcaccataatcaagtagacacgtccaagacgccagttcctccctgaagcgtgagggctgtgagcgcgcagacgacggggcgtgtattacgtgtgcgagcgtcgggccgacaaacgngaaccgtacgggttggcaaacttcctaattcggttcttttgaattacgtcgttgggggacccaaaggggtccttaagtccggg

SEQ ID NO: 306932 - DNA, 575 bp, Homo sapiens
  misc_feature: GZ8MTXP01AGZXT.3.20.B09.1.454.CMB.2.raw
  modified_base (248)..(248): a, c, t, g, unknown or other
  misc_feature (248)..(248): n is a, c, g, or t
  modified_base (416)..(416): a, c, t, g, unknown or other
  misc_feature (416)..(416): n is a, c, g, or t
  modified_base (468)..(468): a, c, t, g, unknown or other
  misc_feature (468)..(468): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctgttggcagctcccagatgggtcctgtcccaggtgcagctgcaagagtcgggcccaggactggtgaagccttcggagaccctgtccctcacctgcactgtctctggtgctccatccgtcttanactgagctggctccggcagcccccagggaaggactggagcatattgggtatgtctttcacagtgggaggactgactacaacgcctcctcacggagtcgggtcaccataatcaagtagacacgtcaagacgcagttcctccctagaagctggaggctgtgacgcgccgnagacacggggcgtggtattacgtgtgcgagtacgtcggcccgacgaaaccgnggaaccgttaacggggttcggacccaaacgttccccgtaattcggttcctttttggaattacgttcggttacgggggaccaaacgggggtaaccaaaggtttccggg

SEQ ID NO: 306933 - DNA, 575 bp, Homo sapiens
  misc_feature: GZ8MTXP01D5AYG.3.20.B09.1.454.CMB.2.raw
  modified_base (278)..(278): a, c, t, g, unknown or other
  misc_feature (278)..(278): n is a, c, g, or t
  modified_base (362)..(362): a, c, t, g, unknown or other
  misc_feature (362)..(362): n is a, c, g, or t
  modified_base (431)..(431): a, c, t, g, unknown or other
  misc_feature (431)..(431): n is a, c, g, or t
  modified_base (488)..(488): a, c, t, g, unknown or other
  misc_feature (488)..(488): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatccctccctgtctgcatctgtagagacagagtcacatcacttgccgggcaagtcagagcattagcgtactaatttaaatggtatcagacaacgaaaccgagggaaacncccctaaagcctcctgatctatcgctagaaactcctatttcgaactaaaggtcgggtacccccatacgaaggttcaggtggacnggtgatcgtagggacagtactttacactactaaaccatcagcggttactcgactaacgtagaaacgttntttagacctaactctaacgttaactacgtacaaacgagaacgtagacctagccaccncctaactaacgttacgttcgggacgggaacgggaacgttaagggttcgaagaactaacgaaaccgtagtggttacgcgttcgaaccg

SEQ ID NO: 306934 - DNA, 576 bp, Homo sapiens
  misc_feature: GZ8MTXP01E2SZS.3.20.B09.1.454.CMB.2.raw
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcgtactaatttaaatggtatcagacaacaaacagggaaacnccctaagctctgatctatgctagaactcctactttagactaaacggtcggggtaccccccatacgaaaggttcaaggtggactaaggtggatcgtagggacagtactttcactactaaccatcgagtcggtactcgaccaaaccgtagtaagttaattttcgaacctaacgttctaacttactacgtaaccaaagaggtaagtaggactacgacaccgtcctaacacgttacgttcggacgggtaacgggaaccgaagggttcggaagtaacacgaaacgtagtggacggtcttgaaccc

SEQ ID NO: 306935 - DNA, 527 bp, Homo sapiens
  misc_feature: GZ8MTXP01EZQ31.3.20.B09.1.454.CMB.2.raw
  modified_base (274)..(274): a, c, t, g, unknown or other
  misc_feature (274)..(274): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctaatttaaatggtatcagcaagaaaccagggaaacncccctaaagctcctgatctatgctgcatccagtttgacaaagtcgggtccatcaagttcaagtgcagtgatcgtgggacagtattcactctcaccatcaacagtctgacaactgaagtatttcggactaaacttactactgtacaactagtacgtttccacctacccctctctaacgtttcggggttgggggaccttaagggtcggagttacgttacaaacgtaacgtgtggctgactaaccgttaagttccg

SEQ ID NO: 306936 - DNA, 548 bp, Homo sapiens
  misc_feature: GZ8MTXP01DAK6D.3.20.B09.1.454.CMB.2.raw
  modified_base (311)..(311): a, c, t, g, unknown or other
  misc_feature (311)..(311): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggagggactggagcatattgggtatgtctttcacagtgggaggactgactacaacgcctccctcaggagtcgggtcaccatatcagtagacacgtccaagagccagttcnccctgaagctgagggctgtgagcgcgcacgacacggccgtgtattaactgtgcgagactgggccacaacagactacggtggcaactcctatgtctttgatatcgtggggaccaagggacgaaagtcggtaccaccgtctcttcacgtccctccaccaacgggcccatccggtccttccccgtcggcctaccctccttaccgacgacgccaccgtcgtcggggcacgcgccggtcccg

SEQ ID NO: 306937 - DNA, 572 bp, Homo sapiens
  misc_feature: GZ8MTXP01A8HMX.3.20.B09.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (362)..(362): a, c, t, g, unknown or other
  misc_feature (362)..(362): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggganaagtcagancattagcgtnttatttaaatggtatcagacaacaaaccgagggaaacacccctaaagcctcctgactctatgctagaatcctactttgacgtaaaggtcggggtacccccagtacgaaaggttcaggtggacnggtaggatcgtagggaactagtatttacactactaacatcagcggtactgacaacgtagaatatttagacaactcaactactagtacaacagagtacgacacgaccaccgtccctaactaaccgttaccggtttcggggacgggaaacggggaaccgttaaggggcggaagaacttaacgaaacggtaacgtggttacgccgttgaaccc

SEQ ID NO: 306938 - DNA, 622 bp, Homo sapiens
  misc_feature: GZ8MTXP01BQ6QD.3.20.B09.1.454.CMB.2.raw
  modified_base (312)..(312): a, c, t, g, unknown or other
  misc_feature (312)..(312): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatcccgtcttactactggagctggctccggcacgccccgagggaaggactggagcatagttgggtatgtctttnacgagtgggagactgactacaacgcctcctcgacggcgtcgggtcaccataactcaagtacgacacgtacccaaaggcgcctaacgtttcctacccgtagaaacgccgttagggacgggtccgtggtacgacggccgccgacgaacggaccgaccgggggtccgttaggttacttaccgtggtcgcgacgtaccgtcggacccgacaaacgaggaaccgttacgggttcggaccttaaaccgtccttaattcggttctttttgaattacgtcgggtacggggtaccaaaggggtaaccttaaggttccgg

SEQ ID NO: 306939 - DNA, 755 bp, Homo sapiens
  misc_feature: GZ8MTXP01EC6TY.3.20.B09.1.454.CMB.2.raw
  modified_base (219)..(219): a, c, t, g, unknown or other
  misc_feature (219)..(219): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcgtctattaaatggtatcagcaacaaaccaggaaacgcccctaagctcctgatctatgctagaatcctacttttgacgtaaaaggtcgggggttacccccccaagttaccgtaaagggtttccaaggttacgggacgtaagggttgggtaaacgttccggttagggggaaccctaagggtaacttttttacccgaacctttacccttaaaaccctaacttaccgaacggtaccggggtttccttacgggaaccctaaaccccgttaggtaaacggttaattttttacgacctaaaccgttaccctaaacctttaaaccttacggttaaccaaaaccgaacggtaaaggttaacggaacctaacggaccaacccggtccccttaacctaaacccgttaaccggttttacccgggggaccgggggtaaacgggggaaaccccggttaaagggggttcgggaaaggtaacgtaaccgaaaaccggtaaaccgttagggttcggggtaaccgttcgggtaacccg

SEQ ID NO: 306940 - DNA, 585 bp, Homo sapiens
  misc_feature: GZ8MTXP01DFDKX.3.20.B09.1.454.CMB.2.raw
  modified_base (291)..(291): a, c, t, g, unknown or other
  misc_feature (291)..(291): n is a, c, g, or t
  modified_base (489)..(489): a, c, t, g, unknown or other
  misc_feature (489)..(489): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccagggactgggtgaagccttcggagaccctgtccctcacctgcactgtctctggtgctccatccgtccttatactggagctggctcggcacgcccccgagggaaggctggancatattgggtatgtctttcactagtgggagactgactacaacgcctccctcacggagtcggtacacccataaactcaagtacaacacgtccaaagagcctagttcctcctagaaacgctgagggctggtcgagccgccgacgacgaccgacggggtccgtagttactacgtgtcgcgagtaacgcggaccgcaaaccnggtaaccgtaacggttcggaccaaacgttccctaattcggttcctttttggaattacgtcggtacggggaccgaaaggggtccttaaaggttccgg

SEQ ID NO: 306941 - DNA, 594 bp, Homo sapiens
  misc_feature: GZ8MTXP01D6942.3.20.B09.1.454.CMB.2.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (477)..(477): a, c, t, g, unknown or other
  misc_feature (477)..(477): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtccctcacctgcactgtctctggtgctccatccgtcttatactganctgctccgcacgccccgagggaaggactggancatagttgggtatgtctttcacgagtgggagactgaactacaacgtcctccgtacgacggacggtcgggtacaacccgataactccaagtacgaacaccgtacaaagacgacctacgttcctaccctagaacgtcgtaggagggtctggtagacgcgccgcgaagaccgacggggccgttagtattacgngtcgcgagacgtcggccacaacagaacgtaacggttcggacttactccttaagttcgttcgttttagaacttagtccggttacgggggaccaaacggggtaacgttaaagttccggg

SEQ ID NO: 306942 - DNA, 531 bp, Homo sapiens
  misc_feature: GZ8MTXP01BOEUT.3.20.B09.1.454.CMB.2.raw
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtcttactactggagctggctccggcagcccccagggaaggactggagcatattgggtatgtctttcacagtgggagactgactacaacgcctcctcacggagtcgggtcaccataatcaagtagacacgtcaagagcagttcctccctgaagctgagggctgtgacgcgccgcagacncggggcgtgtattacgtgtgcgagacgtggccgacaacgngaactacgggttggacaacgtcctattggttcttttggaattatcgtgggggccaaggggcaagttcggg

SEQ ID NO: 306943 - DNA, 575 bp, Homo sapiens
  misc_feature: GZ8MTXP01C502P.3.20.B09.1.454.CMB.2.raw
  modified_base (193)..(193): a, c, t, g, unknown or other
  misc_feature (193)..(193): n is a, c, g, or t
  modified_base (236)..(236): a, c, t, g, unknown or other
  misc_feature (236)..(236): n is a, c, g, or t
  modified_base (271)..(271): a, c, t, g, unknown or other
  misc_feature (271)..(271): n is a, c, g, or t
  modified_base (346)..(346): a, c, t, g, unknown or other
  misc_feature (346)..(346): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatcacttgccgggcaagtcagagcattagcgtntatttaaatggtatcagcaacaaaccagggaaacncccctaaagctcctgactctatgctagaactcctatttgacaaaggtcgggtacccccatacaggttcagtgacngtgatcgtggggacagtactttacacttactaaaccattcaacggtcggtacttacggacctaaacccgttaggtaaagtagtttttagacctaaacttacaaccttactacgtacaaacagagtacgacacgcaaccgcctaacacgttacgtttccggacggtaacgggaccgaaagggttggaacgtaataaccgaaacgaacgtggttcgaacgttcggaacccg

SEQ ID NO: 306944 - DNA, 565 bp, Homo sapiens
  misc_feature: GZ8MTXP01A9EOV.3.20.B09.1.454.CMB.2.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgggnaagtcagagcattagcgtataatttaaatggtatcagacaacaaacgaggaaacncccctaaagcctctgatctatgctagaactcctatttgactaaaggtcgggtacccccatacgtaaggttcaggtggactaaggtgatcgtagggactaggtatttacactactaaccatcgagtcggtactcgactaactagaatatttagactaacgtcaacttactagtacaacgagacgtagacgacgaccacgcctaactaacgttacggtttccggacggaacgggtaaccgaagggttcggaagtaactaaccgaaacgttaacgtcggttacggtcttcgaaccc

SEQ ID NO: 306945 - DNA, 546 bp, Homo sapiens
  misc_feature: GZ8MTXP01DHL2I.3.20.B09.1.454.CMB.2.raw
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactgagctggctccggcagcccccgagggaaggactggagcatattgggtatgtctttcacagtgggagactgactacaacgcctcctcacggagtcgggtcaccgataactcaagtagaccacgtaccaaagacgccagttcctcccgtgaagctaggagggctaggtgacgcgccgcagaccgacggggccgtgtaacttacngtcgcgagactggaccganaacgagaactagggttcggacaacgtcctattcgttctttgaatatcgtggggaccaaggggtaacaagttcgg

SEQ ID NO: 306946 - DNA, 545 bp, Homo sapiens
  misc_feature: GZ8MTXP01DGTQR.3.20.B09.1.454.CMB.2.raw
  modified_base (342)..(342): a, c, t, g, unknown or other
  misc_feature (342)..(342): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtccctcacctgcactgtctctggtgctccatccgtcttactactggagctggctccggcacgcccccgagggaagggactggagcatagttgggtatgtctttcacagtgggagactgactacaacgcctccncacggagtcgggtcaccataactcaagtagacacgtaccaaagacgccagttcctccctagaagctggaggctgtgagcgcgcagacgacggggccgtgtattacgtgtgcgagacgtcggccgacaacgagaacgtacgggttggaccaaacgtcctattcgttcttttgaattagtcgtcggggaccaagggtcaagtcgg

SEQ ID NO: 306947 - DNA, 537 bp, Homo sapiens
  misc_feature: GZ8MTXP01A82I8.3.20.B09.1.454.CMB.2.raw
  modified_base (368)..(368): a, c, t, g, unknown or other
  misc_feature (368)..(368): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccagggaaggactggagcatattgggtatgtctttcacagtgggagactgactacaacgcctcctcacggagtcgggtcaccataatcaagtanacacgtccaagacgcagttcctccgtgaacgctggaggtctgtgagcgcgcagacgacggggcgtgtactacgtgtgcgagacgtggccganaacnggaactcgggttgcttaacgtcctattcggttcttttgaattgtcgtcgggggaccaaggggcttaagtcggg

SEQ ID NO: 306948 - DNA, 563 bp, Homo sapiens
  misc_feature: GZ8MTXP01AVKTF.3.20.B09.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctcatccgtcttanactgagctggctccggcagcccccagggaggactggancatattgggtatgtctttcacagtgggagactgactacaacgcctcctcacggacgtcgggtcacccgataatacaagtacgacacgtaccaagacgcaagttcctccctgaacgctgaggctgtgacgcgcgacagacgacggggccgtggtacttacgtgtgcgagactcggccgacaaccgagaacgtacgggttggaccaactcccgtaattcgttccttttagaattacgtcggttacggggtacccgaaagggtaaccgttaagttccggg

SEQ ID NO: 306949 - DNA, 734 bp, Homo sapiens
  misc_feature: GZ8MTXP01A0XW1.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccagggactggtgaagccttcggagacccctgtccctcacctgcactgtctctggtgctccatcccgtcttactactggagctggctccggcacggcccccgagggaacgggacgtggagcatagtttgggtatgtctttcacgtaggtagggaggtactacgacctacgaaccgccctacccgtacgacggtacggtcggggtaccacctagtaactaccgaagtaacgaaccgtaccgtaccaaaggacgtaccgtaacggtttcctacccgtaggaaacgtccggtaggtaacggggtccgttgggtacggaacgggcccggaccccggacgaaacggtaacccggaaccgggggggtccgtttacggtttaaaccgtttaccggtggttacgggcggtaacggaccggtccggggacccgacgaaaccgacggtaaccggtaacgggttcggaacccttaacgttacccgttagttacggttccgtttttaggaagtttaacgtccgggttacgggggaaccgttaacgggggaaccttaaggtttcccggg

SEQ ID NO: 306950 - DNA, 634 bp, Homo sapiens
  misc_feature: GZ8MTXP01AVGN3.3.20.B09.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (278)..(278): a, c, t, g, unknown or other
  misc_feature (278)..(278): n is a, c, g, or t
  modified_base (407)..(407): a, c, t, g, unknown or other
  misc_feature (407)..(407): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacttgccggganaagtcagagcattagcgttacttatttaaatggtatcagacaacaaaccgaggaaacncccctaagcctcctgactctatgctagaactccatttagactaaaggtcgggtcccccagtacgaaggttcaggttcggacgtggtggtacgtcgtaggggactaggtactttccaacttactaaaccngttcgaggtcggtactacggacctaaccgtaggtaaattaactttaacaaccttactacgttactagtaccaaacgagagtacgaacgacggcctaaccgtccctccgtaaccgttacggtttccggggacgggttaaacggggaacccgtaaggggttacgggaacgacgttaaacccggaaacggtaacgttcggggtacggaccgttaacggaaccttaacccg

SEQ ID NO: 306951 - DNA, 681 bp, Homo sapiens
  misc_feature: GZ8MTXP01C6RV4.3.20.B09.1.454.CMB.2.raw
  modified_base (290)..(290): a, c, t, g, unknown or other
  misc_feature (290)..(290): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatcccgtcttacactggagctggctccggcacgcccccgagggaaggactggancatagttgggtatgtctttcacgaggtgggagtactagacctacgaacgccctccctgacggacgtcgggtacaccataactcaagtacgaacacgtaccaaagacgcctaagttcctacccgtaggaaacgtcgtaggtaacgggtccgttggtacggaacggcccgacccggactaaacgggacccgtaaccggggggtccccggtttaggttaaccttaaccggtggttacggaccggtaggaaccgttcgggacccgacgaaaccgacggtaaccgtacgggttcgggaaccaaaccgttccgtaacgttcggttccttttacggaattaacgttccggttacgggggaacccgttaaagggggtaacccttaaagggtttcccggg

SEQ ID NO: 306952 - DNA, 711 bp, Homo sapiens
  misc_feature: GZ8MTXP01EYQL1.3.20.B09.1.454.CMB.2.raw
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccgagggaaggactggagcatattgggtatgtctttcacgaggtggagactgactacaacgcctcctcgaggacgtcggtacaccatatcagtagacacgtaccaagacgcctagttcctacctagaaacgtcgtggagggcttggtagacgccgacccgctaacggaccgacgggccgttagtacttaacgtgtcggacgaacggtaccgtcgggacccgacgaaacgaacggtaccgtaacggtacggactaaacttccttagttagtcttttagacttacgcgtacgggaacccgaagggacgtaaagttcggtacctaaccgttcctccttaccggaccaccccgtaccgtaaccgtaaaccgggccctaacgttccccgggttaccctttcccccggtccgggaccccgtaacccccgttacccttacccgaaaccggaccggttaacccaccgggttaaccgggtccggggggaccttaaccggcccgggttcccggggtcccccggg

SEQ ID NO: 306953 - DNA, 626 bp, Homo sapiens
  misc_feature: GZ8MTXP01BP7V6.3.20.B09.1.454.CMB.2.raw
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
  modified_base (601)..(601): a, c, t, g, unknown or other
  misc_feature (601)..(601): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgcccccagggaagggactggagcatattgggtatgtctttcacagtgggaggactgactacaacgcctcctcaggagtcggtcaccatatcagtagacacgtaccaagacgccagttctccctgaagctgagggctggtgagcgcgcacgacacggccgtgtattaacngtgcgagcgtgccgacaacgagactacggnggactaactctatcgtcttttgatcgtcgtacgggaccgaagggacgaaagttcgggtcctaacccgttcgttaccttcgacgtcccctacccgaacccggtaaacggggtccccctaacgttcccggttacccttccccccgtaggcccctaaccccgtccccttacccgaacggaccgtcccgacccgttcgggccgggggacccnccggggtcccggcccggttccgggg

SEQ ID NO: 306954 - DNA, 568 bp, Homo sapiens
  misc_feature: GZ8MTXP01BBGU8.3.20.B09.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
  modified_base (540)..(540): a, c, t, g, unknown or other
  misc_feature (540)..(540): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatcgacccagtcctccatccctccctgtctgcatctgtagganacagagtcacatcacttgccggganaagtcagagcattagcgtactatttaaatggtatcagacaacaaaccgagggaaacncccctaaagctcctgatctatgctgaactcctatttcgacgtaaaggtcggggtaccccccagtacgtaacggttcaggttgggacctaaggtggtaaatcggtaggggaactagtatttacactactaaccatcagcgtactcgacacctagaagtatttagactaactactactactagtacaagacgtagtagactagacctccgcctaacaccttaacggttcgggacggtaacgggaccgaagggttggaacgtaanacgtaacgaacgtgaggtccttgaaccc

SEQ ID NO: 306955 - DNA, 579 bp, Homo sapiens
  misc_feature: GZ8MTXP01CYV9E.3.20.B09.1.454.CMB.2.raw
  modified_base (388)..(388): a, c, t, g, unknown or other
  misc_feature (388)..(388): n is a, c, g, or t
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtcttactactggagctggctccggcacgcccccgagggaaggactggagcatagttggtatgtcttcacagtgggagactgactacaacgcctcctcgacggagtcgggtcaccgataactcaagtagacaacgtaccaaagacnccagttcctccctagaacgctggagggctggtgacgccgcgcacgtacgacggggccgttagtaacttacgtgtgccgagaacgtggacccgacaaacgnggaacgttacggnggtaccaacgttccgtaattcgttctttttagaattaacgttcggtacggggaccaaaggggtaaccttaagttccgg

SEQ ID NO: 306956 - DNA, 720 bp, Homo sapiens
  misc_feature: GZ8MTXP01BTGEA.3.20.B09.1.454.CMB.2.raw
  modified_base (270)..(270): a, c, t, g, unknown or other
  misc_feature (270)..(270): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgcggcagtcagagcatagcgtactatttaaatggtatcagacaacaaaccgaggaaacncccctaagctcctgatctatgctagaactcctactttgacgtaaaggttcggggtacccccctagtacgtaaaggtttcaaggttggacgtaaggtggaagttcgtaggggactaacggtattttaccaactttaccgtaaacctagttccgaacggtcgggttaccttacgacccgtaaacccgttaggaaaacgtttacttttacggaacccctaaacgttaccttaaacttaaccgttacggttaacccaaaaccgtacgggtaaagttaaccgggaacctaaccggtacccaaacccggtccccttaaccgtaaacccggttacccggttttacccgggggaccggggtaaacgggggaaacccggttaaagggggttgggaaacggtaacgttaaaccggaaaaacggtaccgttaggggcgttaacccgttaacggtaaccccg

SEQ ID NO: 306957 - DNA, 553 bp, Homo sapiens
  misc_feature: GZ8MTXP01EUZHR.3.20.B09.1.454.CMB.2.raw
  modified_base (247)..(251): a, c, t, g, unknown or other
  misc_feature (247)..(251): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctgtgctcatccgtcttacnnnnngncgcncgcgcgcgacgagagngngnngtagttgtgtgtcgtacgtagagagagacgacacacacgctcccgacgagacgcgacgaacacnctacagacgacacgacgacgacgactacgtctacgacgagagagagcgngagacgacgacgacgacggacgacgtacgtacgtacgtacgtcgtacgacgacgtacgacgaccgaacgaacgaacgttacggtacgttacgtacgtaacgttacgttacgttacgttaagttacgtaacgtacgtacggttacggtaacggaacggtaacg

SEQ ID NO: 306958 - DNA, 630 bp, Homo sapiens
  misc_feature: GZ8MTXP01EIJSE.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatcccgtacttactacgtggagctggctccggcacgcccccgagggaacggactggagctatagtttgggtatgtctttcacgtaggtgggagactggacctaacgaaccgtcctccctacgaccgggacgtcgggtaccaccgataactacgaagtacgaaccacgtaccaaaggacgcctagttacctcccgtagaacgcgtggacgggtcgttagtggacgccgccgacgacgaccgcggggtcgttagttacttacgtggtcggacgacggacgtcgggccacgaaaccgtggaaccgttacggcggacccaaacgttcccttaagttcgttacgttttgaattacgtcggtacggggaaccgttaaggggtaaccaaggtttcccgg

SEQ ID NO: 306959 - DNA, 559 bp, Homo sapiens
  misc_feature: GZ8MTXP01CSHXC.3.20.B09.1.454.CMB.2.raw
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccagggaggactggagcatatgggtatgtctttcacagtgggagactgactacaacgcctcctcgacggagtcggtcaccagtaatcaagtagacacgtacaagacgcagttcctccgtagaacgcgtgagggctgtgacgcgccgnacgacgcggggtccgtgtacttacgngtcgcgagaccgtcggccgacgaaacgcggaacgtacgggttggaccgaaccttacccgtattcgttcttttagaattacgtcggtcggggaccaaggggtaacaagttccgg

SEQ ID NO: 306960 - DNA, 563 bp, Homo sapiens
  misc_feature: GZ8MTXP01B91QA.3.20.B09.1.454.CMB.2.raw
  modified_base (488)..(488): a, c, t, g, unknown or other
  misc_feature (488)..(488): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaacggactggagcatagttgggtatgtctttcacgagtgggagactgactacaacgcctcctcgacggagtcggtcaccataactcaagtagacacgtaccaagacgacctagttctacccgtgaacgcgtggacgggcttggtgacgccgccgcgacgacgacggggtccgttgtacttacgtgtcgcgagactcgggccacgaacngaacgtacggttcggacaacgtcctagttcgttcttttagaatacgtcggtcgggaccaaggggcttaagtccgg

SEQ ID NO: 306961 - DNA, 546 bp, Homo sapiens
  misc_feature: GZ8MTXP01BKH5E.3.20.B09.1.454.CMB.2.raw
  modified_base (310)..(310): a, c, t, g, unknown or other
  misc_feature (310)..(310): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggactggagcatattgggtatgtctttcacagtgggaggactgactacaacgcctccctcaggagtcggtcaccatatcagtagacacgtccaagagccagttcnccctgaagctgagggctgtgagcgccgcacgacacggcctgtattaactgtgcgagactgggccgacaaacagactacgtggacaactcctatgcttttgatatcgtgggccaagggacaagtggtccacgtctcttcagcctccaccgacgggcccatccggtccttcccctcgaccgaccctcccttccgaacgacgcctaccgtcgtcgggggccacgaacgccggtccccgg

SEQ ID NO: 306962 - DNA, 553 bp, Homo sapiens
  misc_feature: GZ8MTXP01DREU7.3.20.B09.1.454.CMB.2.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (474)..(474): a, c, t, g, unknown or other
  misc_feature (474)..(474): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgccccccgagggaacgggactggagcatattgggtatgtctttcacagtgggagactgactacaacgcctcctcacggagtcggtcaccataancaagtanacacgtaccaagagccagttctccctagaacgctagacgggctgtgagcgccgcagacgacggggccgttgtattacgtgtgcgagactcggccgacaaacgngaacgtacgggcggacaaccgtcctagttcgttctttttgaattagtcggtcgggggacgaagggtaacttaagtccgg

SEQ ID NO: 306963 - DNA, 574 bp, Homo sapiens
  misc_feature: GZ8MTXP01AHMEH.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtccttactactggagctggctccggcacgcccccgagggaagggactggagcatagttgggtatgtctttcacgagtgggagactgactacaacgcctcctcgacggagtcgggtacaccataactcaagtacgacacgtaccaagacgcctagttcctccctagaacgctggagggctgtacgagccgccgacgacgacgacggggcgtgttatacgtgtgcgagacgtcggccgacaaacgagaacgtaacgggttcggacaacgtcctaattcgttcttttagaattacgtcggtacgggggtaccaaggggtaaccttaaggttccggg

SEQ ID NO: 306964 - DNA, 565 bp, Homo sapiens
  misc_feature: GZ8MTXP01DLGDT.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactgagctggctccggcacgcccccgagggaggactggagcatagttgggtatgtctttcacagtgggagactgactacaacgcctcctcgacggagtcgggtcaccgataactacaagtacgacaaccgtaccaaagacgccagttcctccctgaacgcgtggagggctgtgacgccgccgcacgaccgacgggggtccgttagttacttacgtgtgcgagacgtggccgacaacgagaacgtacgggttggaccaacgtcctagttcgttcttttgaattagtcggtacggggaccgaagggtaacaagttcgg

SEQ ID NO: 306965 - DNA, 669 bp, Homo sapiens
  misc_feature: GZ8MTXP01DFXK1.3.20.B09.1.454.CMB.2.raw
  modified_base (197)..(197): a, c, t, g, unknown or other
  misc_feature (197)..(197): n is a, c, g, or t
  modified_base (561)..(561): a, c, t, g, unknown or other
  misc_feature (561)..(561): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccatccctccctgtctgcatctgtagganacagatccacatcacgttggccgggacaagtcaagagactattacgtcgttacttaaattttaaagtggtatcgaagaccaaaccgaaaaccgaaggggaaacctaccccgtaaagcctacctagactactatcgtactagtaactccttacgtttacgaacgtaaaggtccgggtacccccagttacggtaacggttcgagggtacgacgtgggtaggtacgttacggtagggaactagttacttactaccttaacctaacctacgtacgacggtccgtacgtacgtaacctaaccgttagtaacgttactttacgacctaactactaacttactacgtacaacgagagtacgactacgaccnccgtctaaccgtaccgttacggttacgggacgggtaacgggtaaccgagggttacggaacgtaacgtaaacgtaaacggtcgtacggttacggtccgttcgtaacccg

SEQ ID NO: 306966 - DNA, 616 bp, Homo sapiens
  misc_feature: GZ8MTXP01BIKNJ.3.20.B09.1.454.CMB.2.raw
  modified_base (344)..(344): a, c, t, g, unknown or other
  misc_feature (344)..(344): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttactactggagctggctccggcacgccccgagggaagggactggagcatagttgggtatgttctttcgacgtaggtgggagactgactacaacgcctccngacggacgtcggacaccataatcaagtagacacgtacaagacgcctagttccnccgtaggaacgcgtggagggctggtcgagcgccgngacgaccgacggggccgttagtacttacgtaggtcgcgaggtaccgtgggacccacgaaacgacggaaccgttcggggcggtaaccttaaaccgttccgttaaagttcggttcctttttaggaacttaacggttccggttacggggggacccttaaaagggggaacccgttaagttaacccggg

SEQ ID NO: 306967 - DNA, 633 bp, Homo sapiens
  misc_feature: GZ8MTXP01C07XA.3.20.B09.1.454.CMB.2.raw
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtagagacagatcacatcacttgccggacaagtcagagcattagcttacttaatttaaagtggtatcagacaacaaaccgagggaaacaccctaagcctctagactctatgactagtaactcctatttacgaacgtaaaggtcgggttaccccagttacgtaaggttcaggttacggactaaggtggtaacttcggtagggacctaagttacttacacttacaaccatcgagtcgtactcgacctaacgtagaattattttacgaactaacgtctaaccgttaactacgtaacaaatacggaagtacgaacgtacgaccgacccgtccctaacacccggttaacgggtttccggggaacggggtaaacgggacccggttaaaaggggttcggaaacgtaaacgtaaccggaaaacgtacggttcgggacgtccgaacgtaacccg

SEQ ID NO: 306968 - DNA, 594 bp, Homo sapiens
  misc_feature: GZ8MTXP01DYHAX.3.20.B09.1.454.CMB.2.raw
  modified_base (476)..(476): a, c, t, g, unknown or other
  misc_feature (476)..(476): n is a, c, g, or t
  modified_base (518)..(518): a, c, t, g, unknown or other
  misc_feature (518)..(518): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaacgccttcggagaccctgtccctcacctgctactgtctcgtggtgctcatccgtcttacactgagtctggctccggcacgccccaggggacggactggagcatattgggtatgtctttcacgagtgggagactgaactacaacgtcctcctcgacggacgtacggggtcaaccgtattaacgtctaagtagaaccacgtaccgaagacgacctagttcctcccgtagaacgctggagggcttagtgacgccgcgcgaacgacgacggggtcgttagtacttacgngtgccgagacgtcggccgacgaaacgcgtaacgtacgggttnaccgttaaacgttccttagttacgttcgttttagcttaagtcgttaggggaccgaaagggtcttaaacggttccgg

SEQ ID NO: 306969 - DNA, 670 bp, Homo sapiens
  misc_feature: GZ8MTXP01C9C14.3.20.B09.1.454.CMB.2.raw
  modified_base (375)..(375): a, c, t, g, unknown or other
  misc_feature (375)..(375): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaacgccttcggagacccctgtccctcacctgcactgtctctggtgctcactccgtcttactacgtggagctggctccggcacgccccgagggaggactggagctattagttgggtatgttcttcgacgtaggtgggagactagacctacgacgtcctcctcgacggtacggtacggtcaaccgtntaaacgctaaggtaacgaccaaccggtaccaaaggacgtaccgtacgtttccctacccgtaggaacgtgtaggacgggtgttcggaggcgccggacccgacgaacggtaccgacgggggtccgttaaggttactttacggttacggtcggacggtacggtaacggtccggacccggaacaaacgaacggtaaccggttacgggccggtaaaccttaccgttaccctagttcggtttctttagtaacgttcgttcgggtacggggaacccgttaagggggtaacaacggtttccgg

SEQ ID NO: 306970 - DNA, 550 bp, Homo sapiens
  misc_feature: GZ8MTXP01EIHQ8.3.20.B09.1.454.CMB.2.raw
  modified_base (277)..(277): a, c, t, g, unknown or other
  misc_feature (277)..(277): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatccctccctgtctgcatctgtagagacagatcaccatcacttgccgggcaagtcagagcattagcgttactaatttaaatggtatcagacaacaaaccgaggaaacncccctaagctctgatctatgctagaactcctatttgacaaaggtcgggtacccccatacgaaggttcaggtcgcnggtgattcgngggactagtactttcactctaaccatcgagtcggtactcgactaactggtaatatttagactaactctactactacgtacaacgagtagtagaccagcaccgcctctacgttacgtttcgggacggacgggaaccgaagggttggagtaacgtacgaaacggtacgtacggttacgtcgttgtaaccc

SEQ ID NO: 306971 - DNA, 539 bp, Homo sapiens
  misc_feature: GZ8MTXP01AMAS0.3.20.B09.1.454.CMB.2.raw
  modified_base (213)..(213): a, c, t, g, unknown or other
  misc_feature (213)..(213): n is a, c, g, or t
  modified_base (411)..(411): a, c, t, g, unknown or other
  misc_feature (411)..(411): n is a, c, g, or t
  modified_base (506)..(506): a, c, t, g, unknown or other
  misc_feature (506)..(506): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcggcccaggactggtgaagccttcggagaccctgtccctnacctgcactgtctctggtgctcatccgtccttatactgagctggctcggcagcccccagggaggctggagcatattgggtatgtctttcacagtgggagactgactacaacgcctcctcacggagtcgggtcacccataatcaagtagacacgtaccaagacgccaagttctccctgaagctgaggctgtgagcgcgnagcacggggctgtattacgtgtgcgagacgtcggccgacaacagaacgtaacgggttggaccttaaacgtcctaattggttcctttttggaattntcggttaggggacccaaaggggaaccaaagtcg

SEQ ID NO: 306972 - DNA, 648 bp, Homo sapiens
  misc_feature: GZ8MTXP01C36EW.3.20.B09.1.454.CMB.2.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttggccgggacaagtcaagagcattagcgttactaatttaaatggtatcagacaacaaaccgaaggaaacncccctaaagctcctagatctatgctagtaactcctacgtttgaacgtaaggtcgggtaccccagtacgtaaggtcagtgggactaaggtggacgtacgtagggacacgttactttacacttacctaaacctataccgaaggtcccggttactacggtacctaaaccgtagtaaacgttacttttaacgaccctaaacgttacctaaacttaaccgtacggttaacccaaacgtaggtacggtaacgaacctacgacccgacccgtcccgtaactaacccggttacgggtttaccggggacggggaaacggggtaccgaaggggttgaacgtaactaaacgaacgtacgtggttacgtcgttcgaaccc

SEQ ID NO: 306973 - DNA, 632 bp, Homo sapiens
  misc_feature: GZ8MTXP01BLKUR.3.20.B09.1.454.CMB.2.raw
  modified_base (293)..(293): a, c, t, g, unknown or other
  misc_feature (293)..(293): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctcgtggtgctccgatcccgtcttactactggagctggctccggcacgccccgagggaaggactggancatagttgggtatgtctttcacgaggtgggagactgactacaacgcctcctcgacggacgtcggtacaacataactcgaagtacgaacacgtacaagcgactacgttcctacccgtggaacgtcgtaggagggtcctggtagacggccgaccgacacgggacccgtacgggggtccgttaggttaacttacgtggtacggcgtaacggtaccgtcgggaccgacgaaacgacggtaaccgtacgggttacgaccttaaacccgttcgtaacgttcggttctttttagaacttcggttcgggacggggaccgttaaaggggtaacccttaaggttcccgg

SEQ ID NO: 306974 - DNA, 735 bp, Homo sapiens
  misc_feature: GZ8MTXP01EG21Y.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtccctcacctgcactgtctctggtggctccatccgtccttactactggagctggctccggcacgcccccgagggaaggactggagcatagttgggtatgtcttcacaggtggagactgactacaacgcctcctcgaggagtcggtcacatatcagtacgacacgtacaagacgcctagttcctacccgtagaacgcgtacggagggtcgtggtcgacgcccgcccgcgaacgaccgtaccgggtccgttagttaacgttacgtggtacgacgtaacgcgtcggaccgaacaaaccgtacgtaacgtacgggtacggacctaaaccttccgttaagttcggtttacgttttttaggaacgtttacgtaccgggttacgggggaacccgtaaaggggaactaaacggttcgggttacccgtaacccggtttcccttaaccggttaccttaaccgggtccccctttacccggaaacccgggtaaacccggggttccccgttaacggtttaccccgggtttaacccccgtttcccccggtcgggtaaccccctacccccgttcccgtaacccgaaacggtaaccccgg

SEQ ID NO: 306975 - DNA, 660 bp, Homo sapiens
  misc_feature: GZ8MTXP01ED4ZH.3.20.B09.1.454.CMB.2.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (275)..(276): a, c, t, g, unknown or other
  misc_feature (275)..(276): n is a, c, g, or t
  modified_base (280)..(280): a, c, t, g, unknown or other
  misc_feature (280)..(280): n is a, c, g, or t
  modified_base (584)..(584): a, c, t, g, unknown or other
  misc_feature (584)..(584): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctnacctgcactgtctctggtgctcatccgtctanactgancngcncgcncgcccgaggaggnnggancatagtggtatgtctttcacgaggtggggagtacgtagaaccttaaccgaaccgtccctacccgtacgaacgggtacggtacggggtccaaccctaagttaactacgtaacggtaaacgaaccgaaacccggttacccaaaaggtaccggtacccgtaaacggtttccctaccccgttaagggaaacgtcgttagggacggggtaccgtgggttacggacggccgacccggacgaaacggtaccgacgggggtacccgttgttaaacgttcgtaggtcgacggagacgtcggaccgtacaaacnggaacgtacggttcgacttacgtccgtattcgttctttagaactagtcggtagggaccaagggtaacttaagtccg

SEQ ID NO: 306976 - DNA, 631 bp, Homo sapiens
  misc_feature: GZ8MTXP01DDZQN.3.20.B09.1.454.CMB.2.raw
  modified_base (374)..(374): a, c, t, g, unknown or other
  misc_feature (374)..(374): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgccactgtctctggtgctccatcccgtcctactctggagctgctccggcacgcccccagggaaggactggagcatagttgggtatgtctttcactaggtgggagactgactacaacgcctccctcacggacgtcgggtacaccataactcaagtanacacgtacaagacgccagttcctcccgtagaacgcgtaggagggctggtcgacggccgccgcaagaccgacgggggtccgtaggttacttacgtgtcggcgagtaaccgtcggacccgaacgaaaccgacggtaaaccgtaacggggttcgggtaaccttaaaccgttcccgttaagttcggttcctttttaaggaacttaacgtcgggttacgggggacccgttaaaagggggtaaccttaaacgggtttcccggg

SEQ ID NO: 306977 - DNA, 624 bp, Homo sapiens
  misc_feature: GZ8MTXP01D2XL5.3.20.B09.1.454.CMB.2.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
  modified_base (537)..(537): a, c, t, g, unknown or other
  misc_feature (537)..(537): n is a, c, g, or t
tcagagacgcactccacgaccggtgctcgatttagtgtagtgtgaagggggcaggagtcagtctcagtcaggacacagcatggacatggacgggtccccgctcagctccgtggggctcctgctactctggctccgaggtgccagatgtgacatccagatgacccagtcctccatccctccctgtctgcatctgtagganacagagtcaccatcacttggccgggactaagtcaagagactagttagcgttactaaattttaaagtggtaatcgaagacaaacgaaaccgaagggaaacncccctaaagcttcctagacttctatcgacttagaaacttcctaagtttcgacgtaaaggttccgggtaccccccagtacgtaaggttcaggtacggganaagggttggacttcggtagggaactagttatttaccactactaaaccntacgagtcgtactacgacaaccgtgtaacgttatttacgacctaacgtactaacttaagtactaacaaacgagagtacgacacgaccaccncctaactacgttcggttaccgggcgggaaaccgggtaacgaagggttgaacgtaacgtaacgaaacgtagtggacggtcttcgaacc

SEQ ID NO: 306978 - DNA, 593 bp, Homo sapiens
  misc_feature: GZ8MTXP01COL38.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtcttactactggagctggctccggcacgcccccgagggaggactggagcatagttggtatgtctttcacgagtgggagactgactacaacgcctccctcgacggagtcgggtcacccgatactacaagtagacaccgtacaaagacgccagttcctacccgtgaaacgctaggagggtctggtgacgccgccgacagaccgcggggtcccgttagtacttaccgtgtcgaccgagaccgtcggcccgacaacgacgtaacgtaacgggttcggaaccaaccgtacgttaagttcgttctttagtaattacgtcgtcgggggacccaaggggtaaccttaaggttcccggg

SEQ ID NO: 306979 - DNA, 660 bp, Homo sapiens
  misc_feature: GZ8MTXP01C618Q.3.20.B09.1.454.CMB.2.raw
  modified_base (281)..(281): a, c, t, g, unknown or other
  misc_feature (281)..(281): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttggccgggacaagtcagagcattagcgttactaatttaaatggtatcagacaacaaaccgagggaaacncccctaaagctcctgactctatgctagtaactcctatttagactaaggtccgggtaccccagtacgtaaggttcaggtacggacgtaaggtgggtacgttacggtacggggactaaggttactttaccctaaccttacctaaacccgtacgtaccgaacggttcccgggttacgttaccggtaacctaaacccgttaggtaaaacgttactttttacgaacccttaaacttaccgtaaccttaactacgtaacaaacgtacgagtacgacacgtaccacgtccctaacgtaccttacggttccgggacgggtaacgggaccgaagggttcggaacgtaacgtaacgaaacgtacgtggttacggtaacttcgtaacccg

SEQ ID NO: 306980 - DNA, 700 bp, Homo sapiens
  misc_feature: GZ8MTXP01DODWV.3.20.B09.1.454.CMB.2.raw
  modified_base (294)..(294): a, c, t, g, unknown or other
  misc_feature (294)..(294): n is a, c, g, or t
tcagagacgcactccacgaccggtgctcgatttagtgtagtgtgaagggggcaggagtcagtctcagtcaggacacagcatggacatgacgggtccccgctcagctccgtggggctcctgctactctggctccgaggtgccagatgtgacatccagatcgacccagtcctccactccctccctgtctgctatctgtagagacagagtcaacctatcacgttcggccgggactaagtcagagctattagcgttattaatttaaatggtatcagacaacgaaaccgaagggaaacnccccaaagctacctgactctatcgctagtaactctatttcgagtaaggtcgggtccccagtacgtaaggttccaggtcgacgtgggtggtaactcggtacgggaacctagttactttactaaccttaactaaaccgtatacgtaggttacccgggttactacggaacctaaaccggttagtaaaagttacgttttaaccgacccttaaacgttaaccctaacctttaaacgttacgtaaaccgaaaccgtagacggttaacgaaccgtacgacccaccgtccctaaccgtaacgttacccggggtttacgggaccgggaaacgggtaaccgttaaaggggttggttaaacgtaagttaaaaccggaaaccggtaagttcgggttcggtaaccttaaccggtaaccc

SEQ ID NO: 306981 - DNA, 609 bp, Homo sapiens
  misc_feature: GZ8MTXP01DMZD3.3.20.B09.1.454.CMB.2.raw
  modified_base (350)..(350): a, c, t, g, unknown or other
  misc_feature (350)..(350): n is a, c, g, or t
  modified_base (545)..(545): a, c, t, g, unknown or other
  misc_feature (545)..(545): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtccttactactggagctggctccggcacgcccccgagggacggactggagcattagttgggtattgtctttcacgtaggtggggagtactgactacaaccgcctccncgacggacgtcggtcaccataactcaagtagaccacgtaccaaagacgcctacgttcctacccgtagaacgtcgttaggacgggtcgtagggtcgaacggccggaccgacgaacgacccgacgggggtcccgttaggttaactttaccggtgtcggacgacgtaacgtcggaccgacaacgacgaacgtacgggngaccttacgtcctgttcgttctttagaattagtcggtacgggacgagggtaacttaagttccgg

SEQ ID NO: 306982 - DNA, 743 bp, Homo sapiens
  misc_feature: GZ8MTXP01CCJLX.3.20.B09.1.454.CMB.2.raw
tcagagacgcactccacgaccggtgctcgatttagtgtagtgtgaagggggcaggagtcagtctcagtcaggacacagcatggacatgacgggtccccgctcagctccgtggggctcctgctactctggctccgaggtgccagatgtgacatccagatcgacccagtcctccactccctccctgtctgctatcgtaggtaggagacagacgtaccaccatcctacgttcggaccgggacaagtcaaggacgctaagttacgtacgttacttaaattttaaagtggtatacgaagaaccaaaccgaaaaccggaacgggaaaaccgtaccccctaaaggtccctaccgtagtacttacttacgtcgtactaacgtaaacttcccgttacgtttagaacggtaaacgggttccgggtaccccctaagttacggtaaggttccgaggtacgggacgtgggtagtacgttacggtagggtactaacggttactttaaccctaaccttacctaaacctcgtaccggtacggtccggttacctacggtaacctacgttagtaacgttactttacaccttaactactacgtaactacgtaacgaacgtagtagtacacgtaccacccgtacctccgtaaccaacggttccgggtaccggggaacgggtaaacggtaccggttaaggggttacgaacggtaaccgtaaacggtaaacggtacgtacggttacgtaaccgttcgtaaccccg

SEQ ID NO: 306983 - DNA, 618 bp, Homo sapiens
  misc_feature: GZ8MTXP01DGIP0.3.20.B09.1.454.CMB.2.raw
  modified_base (306)..(306): a, c, t, g, unknown or other
  misc_feature (306)..(306): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcactgcactgtctctggtgctccatccgtcttacactggagctggctccggcacgccccgagggaaggctggagcatagttggtatgtctttnacgtaggtgggagtactgaactacaacgccctccctacgaacggtacgtcgggtacaacccgtataactactaagtacgaactaaccgtaccaaagtacgacctacgttcctacccgtagaagtcgtaggacgggtctaggtgacgtcgccgacgagaccgtaccgggggtccgttagtaattacgtggtacgacggagttaccgcggcccgaacgaaacgacgtaacggtaccgggttggaccttaaactccgtaattcggttcttttgaattacgtcggtaggggaccaaggggtaaccttaagttccgg

SEQ ID NO: 306984 - DNA, 762 bp, Homo sapiens
  misc_feature: GZ8MTXP01CGGT0.3.20.B09.1.454.CMB.2.raw
  modified_base (202)..(202): a, c, t, g, unknown or other
  misc_feature (202)..(202): n is a, c, g, or t
tcagagacgcactccacgaccggtgctcgatttagtgtagtgtgaagggggcaggagtcagtctcagtcaggacacagcatggacatgacgggtccccgctcagctccgtggggctcctgctactctggctccgaggtgccagatgtgacatccagatcgacccagtcctccactccctccctgtctgcatctaggtagganacagagtaccacatcacgttcggccgggacaagtcagacgtctagttacgtcgttacttaattttaaagtggtaatcgaacgaaccaaaccgaaaaccggaacgggaaaccgtccccctaaaggtcccttccgtagtacttacctagtcgacttacgtaaaccttccgttaagttacgaacggtaacgggtccggtacccctaagtacgtaagggttacgagggtacggacgttaagggtggtacgttacgggtaacggggacttaacgttactttaacccaaccgtttaactaaaccgtacgtaccggtacggttaccggtaccgttacggaaccttaaaccggttaaggtaacgttaacgtttacaaacccttaactaccgtaacttaccgtacggtaacaaacgtacggaagtacgaacgtaccgacctacccgtaccgtaaccgtacgttccgggttacggggaaccgggtaaacggggaacggttaaaggggaccgggttaactaaaccgtaacggtaaacgtacgggttcggttacgggtaacttccggtaacc

SEQ ID NO: 306985 - DNA, 703 bp, Homo sapiens
  misc_feature: GZ8MTXP01EI1NR.3.20.B09.1.454.CMB.2.raw
  modified_base (577)..(577): a, c, t, g, unknown or other
  misc_feature (577)..(577): n is a, c, g, or t
tcagagacgcactccacgaccggtgctcgatttagtgtagtgtgaagggggcaggagtcagtctcagtcaggacacagcatggacatggacgggtccccgctcagctccgtggggctcctgctactctggctccgaggtgccagatgtgacatccagatcgacccagtcctccacttccctccctgtctgctatctaggtaaggagacagactaccactatccacgttcggcccgggataagtcaagagctaagttacgcttacttaaatttaaagtggtaactacgaacgaccaaaaccgaaaaccggaacggggaaaccctacccccgtaaagtccctaccgtagtaacttcctaagtcgtactaacgtaacctttaccgtagtttacgaacggtaaacggtccggtacccctaagtacgtaagggttcagggtcgacgtaaggttggagttcggacgggtactacggttactttacccacttaacctaactgtacgtacggtcgttactacgtaacctaacgtagtaacgttatttacgaacctaacttacctaactacgtacgtaacaaacgngtacgtaaccgctacgacccacgtccctaacgtaccgttacgggttccggggaacggtaaacgggaaccttaagggggttcaaacgttaacgaaacgaacgtacgtcgggttacgcttaacgaacc

SEQ ID NO: 306986 - DNA, 648 bp, Homo sapiens
  misc_feature: GZ8MTXP01EGVRS.3.20.B09.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (528)..(528): a, c, t, g, unknown or other
  misc_feature (528)..(528): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcggcccaggactggtgaagccttcggacgaccctgtccctcacctgcactgtctctggtgctccatccgtccttanactgganctggctccggcacgccccgagggaggactggancatagttggtatgtctttcacgaggtggagtactgactacaaccgtcctcctacgacggacgtcggtacaccgataactacaagtagaccaaccgtaccaagacgacctagttcctccctagaacgtgtacggagggtacttggtacggacggccgccgacgaacggacccgtacgggggtaccgttaggttaaccttaacgtggttacgacggacgtaccgtcggacccacgaaaccnggaaacgttcggggttcgaaccttaaaccgttccttaaagttcgtttccgttttacgtaaagtttcggtaacccgggttagggggtaccccaaaggggttaacccttaaggtttcccggg

SEQ ID NO: 306987 - DNA, 576 bp, Homo sapiens
  misc_feature: GZ8MTXP01BF1XT.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtcccctcacctgcactgtctctggtgctccatcccgtccttatactggagctggctccggcacgcccccgagggaacggactggagcatagttggtatgtctttcacgagtgggagactgactacgaacgcctcctcacggagtcggtcaacctataatcaagtacgacacgtaccaagacgcctagttcctccctagaacgctggagggtctggtgacgcgccgcgaacgaccgacgggggtccgtagtacttacgtgtagcgagtacgtcggccgacaacgagaacgtacggttcggacttaacgtcctaagttcgttcttttaggaattagtcgtacggggacaacgggtaacttaagttccgg

SEQ ID NO: 306988 - DNA, 668 bp, Homo sapiens
  misc_feature: GZ8MTXP01AK0MH.3.20.B09.1.454.CMB.2.raw
  modified_base (484)..(484): a, c, t, g, unknown or other
  misc_feature (484)..(484): n is a, c, g, or t
tcagagacgcactccacgaccggtgctcgatttagtgtagtgtgaagggggcaggagtcagtctcagtcaggacacagcatggacatgacgggtccccgctcagctccgtggggctcctgctactctggctccgaggtgccagatgtgacatccagatcgacccagtcctccatccctccctgtctgcatcgtggtaggagacagagtcaacctatcacgttggccgggacaaggtcaggagtactattaggtcgttacttaatttaaagtggtaactacgaagaccaaaccgaaaaccgaacgggaaacctaccccgtaaagtccctaccgtgactcttagtcggacttacgtaacttcctagtttacgacgtaaacgggtccggggtaccccaagttacgtaagggttccagggtacggactaagggttacgggtagttcggtaacggggaactagttactttaccaaccttacctaaaccngtaccgacggtcgtacctacgacctaaaccgttaggaacgttatttacgaacctaacgttactaaaccgttactacgtaaccaaagtagtaacgtacgactacgaccaccgtcctaacgacgttcgtcgggacggacggtaacgagttcgggataactaccgaacgtgtggttcgtcgcgtaac

SEQ ID NO: 306989 - DNA, 690 bp, Homo sapiens
  misc_feature: GZ8MTXP01D9PWK.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtccctcacctgcactgtctctggtgctccatccgtcttactactggagctggctccggcacgcccccgagggaagggactggagcatagttgggtatgtctttcacagtgggagactgactacacgcctcctcgacggcgtcggtcacctataactcaagtagaaccgacgtaccgaaagacgccgtacgtttccctcccgttagaaacggtccgttagggacggggtaccgttgggtacggaacggcccggacccgacgaaacgaacccggaccggggggtaccccgtttaggtttaactttaaccggttgggtcggacggtaacggtaaccgtcgggaccctaacccgaaacgtacggtaaacccgtcggggttacggtaccttaaaccgttccgttaacgttcgtttcctttttaggaagtttacgtccgggtttacgggggaccccgttaaagggggtaaccttaaggtttcccggg

SEQ ID NO: 306990 - DNA, 617 bp, Homo sapiens
  misc_feature: GZ8MTXP01EDK7G.3.20.B09.1.454.CMB.2.raw
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (427)..(427): a, c, t, g, unknown or other
  misc_feature (427)..(427): n is a, c, g, or t
  modified_base (493)..(493): a, c, t, g, unknown or other
  misc_feature (493)..(493): n is a, c, g, or t
tcagagacgcactccacgaccggtgctcgatttagtgtagtgtgaagggggcaggagtcagtctcagtcaggacacagcatggacatgacgggtccccgctcagctcctggggctcctgctactctggctccgaggtgccagatgtgacatccagatcgacccagtcctccacttccctccctgtctgctatctggtaggagacagactcaccatcacgttggccgggacaagtcagacgactagttacgtcgttattaaatttaaagtggtatcagacaaacgaaaccgacgggaaaccncccctaaagcctacgtgtacttctatcgtactacgtaacttcctagtttacgacgtaacggtcggtaccccagtacgagtcnggtcgntggtgactcggaggactagttactttacactactaacngtcgaggtcgttacacgtaaccaacgtagtaacgttgtttacaccttaacgtcctaacttacgtanaccgaagagtacgacgatccgaccaccgtcctaacgtacgttaccgggttcgggacggaaacgggtacgttaaagggcgttaagaacgtaaacgaacgtagtcggttacgtaaccttcgaaccc

SEQ ID NO: 306991 - DNA, 594 bp, Homo sapiens
  misc_feature: GZ8MTXP01EJ5Q7.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtccctcacctgcactgtctctggtgctccatccgtcttactactggagctggctccggcacgcccccgagggaaggactggagcatagtgggtatgtctttcacgagtgggagtactgactacaaccgcctcctcgacggacggtcggtacaccagtaatcaagtagacaccgtacaagacgctacgttcctacccgtagaacgcgttaggacgggtcttggtagacgccgacccgcgaagaccgacggggtccgttagttacgttaccgtgtcgacgtacgaacgtcggccgaacgaaacgagtaaccgtacgggttggaccttaacgtccgttaattcgttcttttgaatgtcgtcggggaccttagggtaacttaagtccgg

SEQ ID NO: 306992 - DNA, 600 bp, Homo sapiens
  misc_feature: GZ8MTXP01DCJPO.3.20.B09.1.454.CMB.2.raw
  modified_base (195)..(195): a, c, t, g, unknown or other
  misc_feature (195)..(195): n is a, c, g, or t
  modified_base (276)..(276): a, c, t, g, unknown or other
  misc_feature (276)..(276): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttgccgggcaagtcagagcattagcgtctaatttaaatggtatcagacaacaaaccgaggaaacncccctaaagctacctgattctatgctagaactcctactttgactaaaggtcgggtacccccatacgaaggttcaggtggactggtggatcgtagggactagtatttcactactaacatcagcgtactagtaaccgtagtaagtatttacgaaccttaaccttacgtaaccttacgttagtaccaaacgacggtaagtggaaacctcgtacccaaccgtcccttaccgtaaccgttaaccggtttccggggaacgggttaacgggaaccgtaaggggttacggattaacgtaaccaaaagtaaccgtggtacgctcggcctaacg

SEQ ID NO: 306993 - DNA, 687 bp, Homo sapiens
  misc_feature: GZ8MTXP01BVIKO.3.20.B09.1.454.CMB.2.raw
  modified_base (256)..(256): a, c, t, g, unknown or other
  misc_feature (256)..(256): n is a, c, g, or t
  modified_base (288)..(289): a, c, t, g, unknown or other
  misc_feature (288)..(289): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtcttactactganctggctccggcacgccccagggaggactggannatattgggtatgttctttcacgaggtgggagtacgtgaactacaaccgtccctccgtacgacggtacggtcgggtaccaacctataactacgaaggttaacgaaccgtaaccggtacccgaaagtacggacccttaacgtttccctacccgtacggtaaacggtccgtaggggaacgggtccgttagggttacggacgggccgccccggacgaacgtaccccggaaccggggggtcccgttaggttaacgtttaacccgtggtcggacggtaagtaccgtacggcccgacgaaacgcggtaaccggtaacggttcggaccttaaccgttcgtaacgttgttcctttagtaattacgttcggtacggggtaccgaagggtaaccgttaaggttcccggg

SEQ ID NO: 306994 - DNA, 659 bp, Homo sapiens
  misc_feature: GZ8MTXP01DH2DX.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaaggagtcgggcccagggactggtgaagccttcggagaccctgtccctcacctgcactgtctcgtggtcgctccattcccgtccttactactggagcgtggcgtccggcacggcccccgagggaacggacgtggagcgtagtagttggtatgttctttcacgaggtgggagacgtgactacgaaccgtcctccctacgacggacggtcggtcacctataactcgaagtacgacacgtaccaagacgcctacgttcctacccgtagacgtcgtaggacggctggtgacggccgccgacgacgtaccgacggggtccgttagtacgttacgtgtcgacgcggaaccgtcggacccgacaaacgcggtaaccgttaccgggttcggaacccttaacgttacccgttaaggtttcgtttcgttttaacggtaactttacggtccggggttaccggggacccggttaaaaggggtaaccttaaaggggtttcccggg

SEQ ID NO: 306995 - DNA, 668 bp, Homo sapiens
  misc_feature: GZ8MTXP01D6S0U.3.20.B09.1.454.CMB.2.raw
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (408)..(408): a, c, t, g, unknown or other
  misc_feature (408)..(408): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccactccctccctgtctgcatctgtaggagacagagtcaccatcacgttggccggganaagtcaagagctagttagcttactaatttaaatggtatcagacaacaaacgaggaaacnccccaagctctgatctatcgntagtaactcctatttagacgtaaaggtccgggtacccccagtacgtaaggttcaggtcggactggtggagttcggtaggactagtactttccactactaacntacgagtcgtacgcgacctaacgtagtaaacgttacgtttacgaacccttaacgtacctaaccgttacgttacgtaaccaaaccgtaggtaacgtacgaccgtaacggacccctaccggtcccctaaccgtaaccgttaccggggtttacccgggggaaaccgggaaaccggggtaaccggttaaaggggttcggaaaacggtaacctaaaaccggtaaaccggttaaccggtgggttacgggtcgttaaccggaacccg

SEQ ID NO: 306996 - DNA, 683 bp, Homo sapiens
  misc_feature: GZ8MTXP01A8JN4.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtcttactactggagctggctccggcacgcccccgagggaaggactggagcatagttgggtatgtctttcacgaggtgggaggactgacctacaaaccgcctcccgtcgacggacgtcggggtcacccgattaaactcaacggttaacgaacctaaccggtaccgaaacggtacgacccgtaacgggtttcccttaccccgttagggaaacggtcggttacgggaacgggggtccgttggtacgggacgcccggacccgacgaacgaacccgtaaccggggggccgtttaaggttactttaaccgtggttcggaccggacgtaacggttcggacccgacgtaaacgacggaaccgttaacggcggtaccttactacccgttattcgttctttggaattcgttggtacggggacccttaaaggggaacttaaggtaacccgg

SEQ ID NO: 306997 - DNA, 549 bp, Homo sapiens
  misc_feature: GZ8MTXP01BJ6ZM.3.20.B09.1.454.CMB.2.raw
  modified_base (351)..(351): a, c, t, g, unknown or other
  misc_feature (351)..(351): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttacactggagctggctccggcacgcccccgagggaagggactggagcatagttgggtatgtctttcacaggtgggaggactgactacaacgcctccctcgacggngtcgggtcaccataactcaagtacgacacgtaccaagacgcacgttcctccctgaacgctggaggctgtgagcgccgcagacgacggggcgtgtacttacgtgtgcgagacgtggccgacaacagaacgtacggttaggccaacgtcctattcgttcttttgaattagtcgtggggaccgagggtaacgttaagtcgg

SEQ ID NO: 306998 - DNA, 623 bp, Homo sapiens
  misc_feature: GZ8MTXP01CYD6Q.3.20.B09.1.454.CMB.2.raw
  modified_base (429)..(429): a, c, t, g, unknown or other
  misc_feature (429)..(429): n is a, c, g, or t
  modified_base (568)..(568): a, c, t, g, unknown or other
  misc_feature (568)..(568): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtaccttactactggagtcgtggctccggcacgccccgagggaacggctggagcagttagttgggtatgttctttacgacgtaggtgggagtactacgacgtaacgaacgtccctccgtacgacggtaggtcggtcaccataactcaagtacgacacgtacgaagcgacacgtccctaccgagacgngtagagggcttggagcgccgaccgcacggacccgacgggggtacgttaggttaacttacgtaggtcggacgacggaccgtcggacccgacgaaacgaggtaacgtacgggcggtaaccaacggttacctagttacgttntttacgaacgttacgtccgggtacgggaacggttaggggtaaccaacggttccgg

SEQ ID NO: 306999 - DNA, 594 bp, Homo sapiens
  misc_feature: GZ8MTXP01EB0B2.3.20.B09.1.454.CMB.2.raw
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (471)..(471): a, c, t, g, unknown or other
  misc_feature (471)..(471): n is a, c, g, or t
  modified_base (501)..(501): a, c, t, g, unknown or other
  misc_feature (501)..(501): n is a, c, g, or t
  modified_base (520)..(520): a, c, t, g, unknown or other
  misc_feature (520)..(520): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcggcccaggactggtgaagccttcggagaccctgtccctcacctgcactgtctctggtgctccatccgtctactactgagctggctccggcacgccccgagggaggactggagcatagtggtatgttctttcactaggtgggagactgaactacgaaccgtcctaccctgaacggcgtcggtcaccataacncgaagtagacactacgaaagcncctacgttcaccgtagaacgcgtggaggtctgtacggacgcgccgatagaccgaacgggggtccgttggttaaacttacgtggngcgaacgaacgttcggggccacgaaaccgnggaaccgtaacggggttcncttaaaccggtccttattagttccttttagggaattagtcgggtcggggaccgaaggggtaaccaaggtttcgg

SEQ ID NO: 307000 - DNA, 624 bp, Homo sapiens
  misc_feature: GZ8MTXP01DIPIH.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaacgccttcggataccctgtccctcacctgcactgtctctggtgctccatccgtcttacactgagctgctccggcacgccccgagggacggactggagcaagtagttggtatcgtcttcacgtaggtgggagactagactacaacgtcctccctacgacggtacggtcggtacactataataccgaagtacgacgaccgtaccgaaagacgtctaacgttcctcccgtaagaacgctggaggacgttgaggacgcgaccgacgtacggaccgtaacgggggccgttagttaacttaccgttggacgcggaaacgtccggtcgggcccgaacaaacgaaggtaaccgtcgggttacggaccttaaaccttaccgtagttcgttcttttagaattcgtaacgggtcgggacgaaacgggtaaccttaagttcccgg

SEQ ID NO: 307001 - DNA, 670 bp, Homo sapiens
  misc_feature: GZ8MTXP01DOSVJ.3.20.B09.1.454.CMB.2.raw
  modified_base (293)..(293): a, c, t, g, unknown or other
  misc_feature (293)..(293): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtccctcacctgctactgtctctggtgctcatccgtcttactactggagctggctccggcacgcccccgagggaacggactggancatagttgggtatgttcttcgacgaggtgggaggtactagaacctacaaaccgtcctccctcgaaggtacggtcgggtacacctataactcaagtacgacaaccgtaccaaagacgacctagttccctacccgtagaacgcgttaggacgggtctggtgacgccgccgacgaacgaccgacgggggtcgttacgttaagtttaccgtggttcgacgacggtaaccgtcggacccggaacaaacgtacggaaccgttacggggttcggaaacccttaaaccgttccgttaagttacggtttcctttttagggaactttaacgttccggggttaagggggaccccggaaaaggggtaaccgttaaacgggtttcccggg

SEQ ID NO: 307002 - DNA, 629 bp, Homo sapiens
  misc_feature: GZ8MTXP01CIJ0E.3.20.B09.1.454.CMB.2.raw
  modified_base (294)..(294): a, c, t, g, unknown or other
  misc_feature (294)..(294): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
  modified_base (558)..(558): a, c, t, g, unknown or other
  misc_feature (558)..(558): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctgttggcagctcccagatgggtcctgtcccaggtgcagctgcaagagtcgggcccaggactggtgaagccttcggagacccctgtcccctcacctgcactgtctctggtgctccattcccgtcttactactggagctggctccggcacgccccgagggaaggactggancatagttgggtatgtctttcacgaggtgggaggactgactacacgcctcctcgacggtacggtcgggtcaccataactcaagtaacgacacgtccaaagacgtccaaagttcctacccgtagtaaacgccgtagggaacgggtcgttaggtggaacgccgaccgacgaagaccgtaacgggggccgttaggtaacttacgtgtgacgacgacgtcggcccgacaaacgnggaacgtaacgggnggtacaaaccgttccgttaancgtttcgttttcggaattacggttaaccggtacgggggtacccaaagggggtaacccaaaggtttcccggg

SEQ ID NO: 307003 - DNA, 586 bp, Homo sapiens
  misc_feature: GZ8MTXP01DJ1JN.3.20.B09.1.454.CMB.2.raw
  modified_base (292)..(292): a, c, t, g, unknown or other
  misc_feature (292)..(292): n is a, c, g, or t
tcagagacgcactccacgaccggtgctcgatttagtgtagtgtgaagggacagggtctccggaaggcttcaccagtcctggacctcctgtgcaagaacatgaaacatctgtggttcttccttctcctggtggcagctcccagatgggtcctgtcccaggtgcagctgcaagagtcgggcccaggactggtgaagcctttcggagaccctgtccctcacctgcactgtctctggtggctccatccgtcttactactggagctggctccggcacgcccccagggaggactggancatagtggtatgtctttcgactaggtgggagactgactacaacgcctcctcgacggacgtcggtacacctataactcaagtagacacgtacaagacgcctacgttccctcccgtagaacgcgtaggacgggctggtgacgcgaccgcgacgacgacggggtccgttagttacttacgtgtcgcgacgtacgtcggaccgacaaacgaggtaacgtacgggttcggacttaacgttcctagttcgttctttagaattacgtcggtacggggaccgaagggtaacttaaggtccgg

SEQ ID NO: 307004 - DNA, 772 bp, Homo sapiens
  misc_feature: GZ8MTXP01CQ7S5.3.20.B09.1.454.CMB.2.raw
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccactcctccctgtcngcatcgtagtagganacagagtccaccatcctacgttcggaccgggacaagtcgaagagctaattagtcgttacttaatttaaagtggtaactacacgaccaaaccgaaaccgaacgggaaacctacccctaaagtcctacctagactacgtatcgtactacgtaactccgttagttcgaacgtaacggtccggtacccctagtacgtacggttcgaggtcggactgggtagtacgtacgggtacgaacgtacgttactttacctaacccttaaccgtaaccgtactaccggtaacggtcccggttacgtacgtaccctaaaccgttaaggttaacgtttacgttttaccgaacccttaaacgttaccttaaacccgttacgttaacgtaaccggaaaccgtaggtaacgttacgggaacctaccggtacccctacccgtaacccgttaaccgttaaacccggttccggggttcccgggggaacggggaaaaccgggttaacggggttaaacggggttacggaaaccgttaacgaaaacccggtaaccggtaaggttcggggttaccgtaacccgttaacggtaaccc

SEQ ID NO: 307005 - DNA, 603 bp, Homo sapiens
  misc_feature: GZ8MTXP01DU4IV.3.20.B09.1.454.CMB.2.raw
  modified_base (291)..(291): a, c, t, g, unknown or other
  misc_feature (291)..(291): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtccctcacctgcactgtctcgtggtgctccatccgtcttactactggagctggctccggcacgccccgagggaggactggancatagttgggtatgttctttcacaggtgggagactgactacaacgtcctccgtacgacggcgtcggtacacataatcaagtacgacacgtacaagacgccagttcctccgtaggaacgtcgtaggagggtctggtagacggccgaccgacgacgaccgacgggggtcccgttagttaacttacgtgtcgacgacgtacgtcggaccgactaaccgagtaaccgtcggacggtacttaacccgttccttaattcgttcgttttagaacgttcgtcgggttacggggacgaacgggtaacgttaaggttcccgg

SEQ ID NO: 307006 - DNA, 587 bp, Homo sapiens
  misc_feature: GZ8MTXP01A9NQ6.3.20.B09.1.454.CMB.2.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (498)..(498): a, c, t, g, unknown or other
  misc_feature (498)..(498): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctnacctgcactgtctctggtgctcatccgtcttanactgganctggctccggcacgccccgagggaggctggncatagtgggtatgtctttcacaggtggagactgactacaacgcctcctcgacggacgtcgggtacaccataactcaagtacgaccacggtaccaaagacgtcctaacgtttcctacccgtaggaacgtccggtggtacgggtctggtagacggcgccgacgacgaccgcgggggccgttagtattacgtgtgcgagacgtcggccgacaacgngtaaccgtacggttggacaaaccgttctaagttcgttcttttaggaattacgtcggtcggggtaccgaacgggtaacttaacggtccgg

SEQ ID NO: 307007 - DNA, 721 bp, Homo sapiens
  misc_feature: GZ8MTXP01DKG73.3.20.B09.1.454.CMB.2.raw
  modified_base (537)..(537): a, c, t, g, unknown or other
  misc_feature (537)..(537): n is a, c, g, or t
tcagagacgcactccacgaccggtgctcgatttagtgtagtgtgaagggacagggtctccgaaggcttcaccagtcctggacctcctgtgcaaagaacatgaaacatctgtggttccttccttctcctggtggcagctcccagatgggtcctgtcccaggtgcagctgcaagagtcgggcccaggactggtgaacgtccttcggagaccctgtccctcacctgcactgtctcgtggtgcctccattcccgtccttactactggagtctggcctccggcacgcccccgagggaaggctggagcagtagtttgggtatggtctttcgacgtaggtgggaggactagaccgtacaaccgcctcccgtgacggtacggtcggtacacctaataactacaagtacaaccgtaacgtaccaaaggacgtaccgtaacggtttaccctacccgttaaggaaacgccgttaggaacggggtcttggtaggaaccggccgaccgcaagaaccgacgggggtacccgttagttaaccgtttaaccgnggtcgaccggagtacccgtacgggcccgtaacgaaaccgtacggtaaaccggtaacggttccgggtaaacccttaaccgtttacccgttaagttacccggttttgttttaacgtaacgtttacggtccggttacgggggaaaccccgttaaaaggggtaacccgttaaaacggtttccccgggg

SEQ ID NO: 307008 - DNA, 748 bp, Homo sapiens
  misc_feature: GZ8MTXP01DXODX.3.20.B09.1.454.CMB.2.raw
  modified_base (288)..(288): a, c, t, g, unknown or other
  misc_feature (288)..(288): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagacgtcacatcacttggccgggcaaagtcagagcagttacgcgttattaatttaaagtggtatcagacaaccgaaaccgagggaaaccncccctaaagcctacctagtacttactatcggtctagtaaacttccgtactttgaacgtaaagggttccgggtaaccccccaagttcgtaaaggtttcacgggtagggactaagggtcgtagtcgggtagggacctaggttaaacttttcaaccttacctaaacctagtaccgaacgggttcggtactacggtaccgtaaaccgttagggtaaactttacgttttacgaaccccttaaacgttcccttaaacgtttacctacgggttaaacccaaacgggaggttaacgttaaaccggacgtaaccggacccaacccggtccccttaaaccgtaaccgttaccgggggttttaccggggaaacgggtaaaccgggggtaaacccgttaagggggttacgggaaactaaccgtaaaaccgtaaacggtacggtttcggacgggtaaccttcgggtaaacccc

SEQ ID NO: 307009 - DNA, 584 bp, Homo sapiens
  misc_feature: GZ8MTXP01BWEEH.3.20.B09.1.454.CMB.2.raw
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
  modified_base (488)..(488): a, c, t, g, unknown or other
  misc_feature (488)..(488): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaggactggagcatagtggtatgtctttcanagtgggagactgactacaacgcctccctcacggacgtcgggtacaccataacncaagtagaccacgtccaagcgacctagttcctcccgtagaacgcgtggagggctaggtcgacgcgccgacgacgaccgacggggtccgtaggttacttacgtgtcgacgagacgtcggacccganaaacgacgtaacgtacgggttcggacaaaccgtcctaagttcgttcttttagaacttgtcggtcggggaccgaagggtaaccttaaggttaaccgg

SEQ ID NO: 307010 - DNA, 646 bp, Homo sapiens
  misc_feature: GZ8MTXP01C56MK.3.20.B09.1.454.CMB.2.raw
  modified_base (289)..(289): a, c, t, g, unknown or other
  misc_feature (289)..(289): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtcttactactgagctggctcggcacgccccgagggacggactggancatattgggtatgtcttcacagtgggagactgactacaacgcctcctcgacggacgtcgggtcacctataactcaagtacacgaacgtaccaagacgccaagttcctacccttaggaaacgtcgtaggacgggtctacgggtgaacggcccgacccggacgaacggaccgaacggggggtcccggttaggttaacttaacgtcggttcgaccggtaggtaaaccgtcgggacccggacaaacgacggtaaccgtacggggttacggtaccaaaccgttccgtaagttcgttccgttttagaacgttaacgtcgggttacggggaccgttaaacgggggaacttaaacgggttcccgg

SEQ ID NO: 307011 - DNA, 660 bp, Homo sapiens
  misc_feature: GZ8MTXP01BGQ8L.3.20.B09.1.454.CMB.2.raw
  modified_base (229)..(229): a, c, t, g, unknown or other
  misc_feature (229)..(229): n is a, c, g, or t
  modified_base (298)..(298): a, c, t, g, unknown or other
  misc_feature (298)..(298): n is a, c, g, or t
  modified_base (555)..(555): a, c, t, g, unknown or other
  misc_feature (555)..(555): n is a, c, g, or t
  modified_base (650)..(650): a, c, t, g, unknown or other
  misc_feature (650)..(650): n is a, c, g, or t
tcagagacgcactccacgaccggtgctcgatttagtgtagtgtgaagggggcaggagtcagtctcagtcaggacacagcatggacatgacgggtccccgctcagctcctggggctcctgctactctggctccgaggtgccagatgtgacatccagatcgacccagtcctccacttccctccctgtctgctatctgtaggagacagagtccaacatcacgttgccggganaacgtcagagctattagcgttattaatttaaagtggtaatcacgacaaccgaaaaccgacgggaaaccncccctaagcctctagtactctatcgtctagtaacttccgttacgtttacgacgtaaacgggtccggttaacccccagttacggtaaggttcgacggttaggacgtaagggttcgaacgttacgggtacgggactaagttactttacaccttactaaacctagcgtacggtcggttactacggtaacctaaccgtaggtaaacttcgtttacgacctaaacgtcttaacgttactagaactaacgagtacgacgaccncgtacccgaccgcccctaagttacccggttacgggaccgggaaacgtaaccggagggttacgaaacttacgaaacgaaaccgtgtaggcgttacncgccgttaac

SEQ ID NO: 307012 - DNA, 571 bp, Homo sapiens
  misc_feature: GZ8MTXP01BBNZT.3.20.B09.1.454.CMB.2.raw
  modified_base (392)..(392): a, c, t, g, unknown or other
  misc_feature (392)..(392): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttactactgagctggctccggcacgccccgagggacggactggagcatagttgggtatgttctttcacgaggtgggagactgaactacgacgcctcctcacggacgtcggcacataactcgaagtacgacacgtcaagacactagttcnccgtagaacgcgtgacgggctggtagacggcgccgacacgaccgacggggtcccgtagttacttacgtgtcgcgagtacgcgtccgacaacgtgaacgttaacggcgaccacgtccgtagttcgttcttttagaacttcgtcggtacggggaccgaaaggggtaaccttaaagttccgg

SEQ ID NO: 307013 - DNA, 631 bp, Homo sapiens
  misc_feature: GZ8MTXP01BCPSN.3.20.B09.1.454.CMB.2.raw
  modified_base (238)..(238): a, c, t, g, unknown or other
  misc_feature (238)..(238): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagagacgcactccacgaccggtgctcgatttagtgtagtgtgaagggggcaggagtcagtctcagtcaggacacagcatggacatgagggtccccgctcagctccgtggggctcctgctactctggctccggaggtgccagatgtgacatccagatcgacccagtcctccatccctccctgtctgctagttcgtaggtaggacgacagtacgtccaccatcacgttcggccggganaagtcagagtcagttagcgttataatttaaagtggtatcagacaacaacgaggaacncctaanctcngatctatcgtcagtactcctattgactaaaggtcggtaccccagtacgtaagtcaggtcggactggtggtaatcggtaggggtaactaggttactttaccaacttactaaccctatcgaacgtcggtacctagtacctaaaccgtaggtaaattacgtttacgaacccttaaacgtttactaacgtacgttaacaaactggtaacttacaccgttacgttccccgtacgtcgtccgttcggggacgttcggggtaaccgagggttaggaaccggttagacggttacggtaatcgggtaacgaccgttgacccgtaacttcgttccg

SEQ ID NO: 307014 - DNA, 477 bp, Homo sapiens
  misc_feature: GZ8MTXP02GKXR5.3.20.B09.1.454.CMB.2.raw
  modified_base (336)..(336): a, c, t, g, unknown or other
  misc_feature (336)..(336): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtccccatcaagttcagtgcngtgatctgggacagatttcactctaaaccatcagcgtctgcaacctgaagattttagcaactcactactgtcaacagagtgaacagcacgctcacactttcggcggaggaccaggtgagaagtcaaacgactgaggctgac

SEQ ID NO: 307015 - DNA, 529 bp, Homo sapiens
  misc_feature: GZ8MTXP02G5QNU.3.20.B09.1.454.CMB.2.raw
  modified_base (311)..(311): a, c, t, g, unknown or other
  misc_feature (311)..(311): n is a, c, g, or t
  modified_base (359)..(359): a, c, t, g, unknown or other
  misc_feature (359)..(359): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggactggagcatattgggtatgtctttcacagtgggaggactgactacaacgcctccctcaggagtcgggtcaccatatcagtagacacgtccaagagccagttcnccctgaagctgagggctgtgagcgccgcagacacggccgtgtattacngtgcgagactggccgcaaacagactacggtggcaactcctatgctttgatatctgggaccaagggacaatggtcacgtctcttcacgcctccaccaacggcccatccggtccttccccctcggccaccctcctaccaacgacgccacctcgtcggggcacgacgcgcccg

SEQ ID NO: 307016 - DNA, 487 bp, Homo sapiens
  misc_feature: GZ8MTXP02GFJGD.3.20.B09.1.454.CMB.2.raw
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctattaaatgtatcagcacaaaccagggaaancccctaaagctcctgatctatgctgaatccatttgcaaagtgggtccccatcaagttcagtgcngtgatctgggacagatttcactctaaaccatcagcgtctgcaacctgaaagtattttagcaaactcactactgtacaaacagagtgacagcacgcctcacactttcggacgacgggaccgaaggtggaagaatacaaacgaactgacggctagac

SEQ ID NO: 307017 - DNA, 494 bp, Homo sapiens
  misc_feature: GZ8MTXP02HHJE8.3.20.B09.1.454.CMB.2.raw
  modified_base (468)..(468): a, c, t, g, unknown or other
  misc_feature (468)..(468): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccaggaaagcccctaagctcctgatctatgctgaaatccactttgcaaagtggggcccccatcaaggttcagtggcagtgatctgggacagatttcactctaacatcagcgtctgcaacctgaagattttgcaactctaactactgtacaacagagtgacagcacgcctcactagtttcggcggacgggaccgaaggtaggaagaanacgaaaacgactagtcggactagacc

SEQ ID NO: 307018 - DNA, 585 bp, Homo sapiens
  misc_feature: GZ8MTXP02JI3VA.3.20.B09.1.454.CMB.2.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
tcagagacgcactccacgaccggtgctcgatttagtgtagtgtgaagggggcaggagtcagtctcagtcaggacacagcatggacatgagggtcccgctcagctcctggggctcctgctactctggctccgaggtgccagatgngacatccaggatgaccagtcgtccagtcctaccgtgtctagcatctgagganacagancacatcactcgcggacagacagagacatagtacgtactaattaattagtatacanacaacaaacgaacggaaacgacctaacgactctagatactatnactagtactactactacgtacgtaacggtacggtacccgtactacgtaacgtacgtagtagacgngtagtagtacgtagacgtagtacttactactactaaactaactacgtacgtacgtacgtacgtactaacgtaacgtaagtatttacgtactaactactactactacgtacaacgaagtagtacgacgacgacacgactactactacgtacggtacggaacggaacgaacggtaaggaagaacgtaaacgaaaacgtaaacgtacgtacgtacgtacgacg

SEQ ID NO: 307019 - DNA, 484 bp, Homo sapiens
  misc_feature: GZ8MTXP02F86IE.3.20.B09.1.454.CMB.2.raw
  modified_base (334)..(334): a, c, t, g, unknown or other
  misc_feature (334)..(334): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaatggtatcagcacaaaccaggaaagcccctaaagctcctgatctatgctgaatccactttgcaaagtgggtccccatcaagttcagtgcngtgatctgggacagatttcactctaaaccatcagcgtactgcaacctgaagtattttgcaaactcaactactgtacaaacagagtgacagcacgcctcacactttcggcggacggaccaaggtgagaatacgaaacgactgtaggctgac

SEQ ID NO: 307020 - DNA, 480 bp, Homo sapiens
  misc_feature: GZ8MTXP02JACZM.3.20.B09.1.454.CMB.2.raw
  modified_base (334)..(334): a, c, t, g, unknown or other
  misc_feature (334)..(334): n is a, c, g, or t
  modified_base (419)..(419): a, c, t, g, unknown or other
  misc_feature (419)..(419): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctattaaattggtatcagcacaaaccaggaaagcccctaagctcctgatctatgctgaatccactttgcaaagtgggtccccatcaagttcagtggcngtgatctgggacagatttcactctaacatcagcgtctgcaacctgaagattttagactaactcactactgtacaacagagtgacngacacgcctcacacttcggacggacggaccaaggtgagaagtacaaacgactaggcgctgc

SEQ ID NO: 307021 - DNA, 476 bp, Homo sapiens
  misc_feature: GZ8MTXP02J2VIN.3.20.B09.1.454.CMB.2.raw
  modified_base (218)..(218): a, c, t, g, unknown or other
  misc_feature (218)..(218): n is a, c, g, or t
  modified_base (416)..(416): a, c, t, g, unknown or other
  misc_feature (416)..(416): n is a, c, g, or t
  modified_base (474)..(474): a, c, t, g, unknown or other
  misc_feature (474)..(474): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcgtctattaaattggtatcagcacaaaccaggaaagcccctaagctcctgatctatgctgaatccatttgcaaagtgggtcccccatcaaggttcagtggcagtggatctgggacagatttcactctaaccatcagcgtctgcaacctgaagattttgacaactcactactgtacaacagagngacagcacgctcacacttcggcgaggaccaaggtgaagaagacaaacgaactggcgcngc

SEQ ID NO: 307022 - DNA, 578 bp, Homo sapiens
  misc_feature: GZ8MTXP02JRHFM.3.20.B09.1.454.CMB.2.raw
  modified_base (277)..(277): a, c, t, g, unknown or other
  misc_feature (277)..(277): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcgtactaatttaaattggtatcagcaacaaaccgaggaaacncccctaagctcctgatctatgactgaactctatttgacaaaggttggacccccatcgtaaggttcaggtggacaggtggatcgtagggactagtactttcactactaaccatcaggtcgtctcgacctaaccgtgaagttattttacgactaactactaactacgttacgtactaaagttaagagtacgacgacgtccaacgccctactaccgttacggtttacggggaccgggtaacggggaaccgaacggggtaggaacgtaagtaaccgaaaacggtacgtaggtacggtctacgacc

SEQ ID NO: 307023 - DNA, 527 bp, Homo sapiens
  misc_feature: GZ8MTXP02IDNA4.3.20.B09.1.454.CMB.2.raw
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcgttctaatttaaattggtatcagacaacaaaccgagggaaacgcccctaagctccngatctatgctagaactccactttgactaaaggtcgggtcccccatccgaaggttcaggtgcnggtgatcgtgggacagtatttcactcaacatcagcgtctgactaacctagaagtattttagactaactactactactagtacaacagatgaacagacacgcctacactacgttcggacggaacgggaccgaaggtgagtaacgtaacgaaacgaacgttggacgacgtagacccg

SEQ ID NO: 307024 - DNA, 502 bp, Homo sapiens
  misc_feature: GZ8MTXP02H5RAK.3.20.B09.1.454.CMB.2.raw
  modified_base (338)..(338): a, c, t, g, unknown or other
  misc_feature (338)..(338): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtccccatcaaggttcagtggcnggtgatcgtgggacagatttcactctaaccatcagcgtctgcaacctgaagattttagctaactcactactgtacaacagagtgacagcacgcctacactactttcggcggaacgggaccgaaacggtggaagaagtacgaaaacgactaggtcggtctcgacc

SEQ ID NO: 307025 - DNA, 529 bp, Homo sapiens
  misc_feature: GZ8MTXP02GYKOY.3.20.B09.1.454.CMB.2.raw
  modified_base (390)..(390): a, c, t, g, unknown or other
  misc_feature (390)..(390): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatcccgtccttactactggagctggctccggcacgcccccagggaaggactggagcatattgggtatgtctttcacagtgggagactgactacaacgcctccctcaggagtcgggtcaccatatcagtagacacgtccaagagccagttccnccctagaagctgagggctgtgagcgcgnagacacggccgtgtattacgngtgcgagactggccgacaaacgagacgtacggtggaccaaacgtcctatcgtcttttgaattatcgtcggggaccaaagggacaagtcgg

SEQ ID NO: 307026 - DNA, 523 bp, Homo sapiens
  misc_feature: GZ8MTXP02JSZT3.3.20.B09.1.454.CMB.2.raw
  modified_base (194)..(194): a, c, t, g, unknown or other
  misc_feature (194)..(194): n is a, c, g, or t
  modified_base (346)..(346): a, c, t, g, unknown or other
  misc_feature (346)..(346): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggacaagtcagagcattagcgtctattaaatgtatcagcacaaacaggaaacgcccctaagctcctgatctatgctgaactcctactttgactaaaggtcggggtacccccatacgtaaggttcagtggcngtggatcgtgggacagtatttcactctaaccatcagcgtctcgactaacgtgaacgtatttagactaactctactactgtacaacagagtgacagacacgcctacactacgttccggacggacgggaccgtaagggtaggaagaacgtacgaaaacgacgtgtacggtactacgacc

SEQ ID NO: 307027 - DNA, 523 bp, Homo sapiens
  misc_feature: GZ8MTXP02HX1QK.3.20.B09.1.454.CMB.2.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
  modified_base (343)..(343): a, c, t, g, unknown or other
  misc_feature (343)..(343): n is a, c, g, or t
  modified_base (426)..(426): a, c, t, g, unknown or other
  misc_feature (426)..(426): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggnaagtcagagcattagcgtctatttaaattggatcagcacaaaccaggaaacncccctaagcctcctgatctatgctagaactccatttgacaaaggtcgggtcccccatcaaggttcaggtggcngtgatcgtgggacagtatttcactacaacatcagtcgtctcgcaaacctgtaagtatttgactaactctaactactgtacaanagagtgacagcaaccgcctacacctacgtttacggacgggaacgggaacccgaagggtaggaagaacgtaacgaaaacgactggtacggctacgacc

SEQ ID NO: 307028 - DNA, 549 bp, Homo sapiens
  misc_feature: GZ8MTXP02GM0NJ.3.20.B09.1.454.CMB.2.raw
  modified_base (341)..(341): a, c, t, g, unknown or other
  misc_feature (341)..(341): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaacgcccctaaagctcctgatctatgctgaactcctactttgcaaagtggggtccccatcaagttcagtgcngtgatcgtgggacagtatttcactactaaaccatacagcggtactgacaacctagaatattttagctaaactctaactactacgtacaaacgagagtagacagccacgccctactaacctaccgtttccggggacgggacgggaacccgaaaggggttacggaagaacgttacgaaaaccggtaaacgtggtacggacttacggaccc

SEQ ID NO: 307029 - DNA, 523 bp, Homo sapiens
  misc_feature: GZ8MTXP02IFKEF.3.20.B09.1.454.CMB.2.raw
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggagactgactacaacgcctccctcaggagtcgggtcaccatatcagtagacacgtccaagagccagttcnccctgaagctgagggctgtgagcgcgcacgacacggcctgtattacngtgcgagacgtggccgnaaacngactaggtggcaactcctatgcttttgatatcgtgggcctaagggacaagtggtcacgtctcttcagcctcacacggccatccggtcttcccctcgccaccctcctccaacgacgcacctcgtcggggcacgacgcggcccgg

SEQ ID NO: 307030 - DNA, 652 bp, Homo sapiens
  misc_feature: GZ8MTXP02JP1FX.3.20.B09.1.454.CMB.2.raw
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacatcacttggccggnaagtcagagcattagcgtctatttaaatggtatcagcacaaacgaggaaacncccctaagctcctgatctatgctagaatcctacgtttgacgtaaaggtcggggtacccccatcgaaaggttcagtggacaggtggatcgtagggacaggtactttcacttactaacctatcaggtaccgtctacggacctaaacccgtagtaaacgttacttttaaccaaacttcctaaccttactacggttacctaaaaccgaaggacgttacgaaccgtacggtacccgaaccgaccctacgtaaccgttaccggtttaccgggggaaccggggtaaacggggtaaacccgaaagggggttacgggaaacgtaaaccgttaaaccggaaaaccggttaacggtaccgggtagggtacccgtttaacggacccttaaacccg

SEQ ID NO: 307031 - DNA, 528 bp, Homo sapiens
  misc_feature: GZ8MTXP02J2SKA.3.20.B09.1.454.CMB.2.raw
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
  modified_base (476)..(476): a, c, t, g, unknown or other
  misc_feature (476)..(476): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactgagctggctcggcagccccagggaggactggagcatattgggtatgtctttcacagtggagactgactacaacgcctcctcacggagtcgggtcaccatactcngtagacacgtaccaagacgccagtcctccctagaacgctgaggctgtgagcgccgcacggacncggccgtgtataccgtgtcgcggtaagcgtcggccgacaaaacgagtacgtacggnggacaaactcctatcgtctttagaatactcgtgggaccagggactaagtcgg

SEQ ID NO: 307032 - DNA, 498 bp, Homo sapiens
  misc_feature: GZ8MTXP02H0AI9.3.20.B09.1.454.CMB.2.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcgtctatttaaatggtatcagcacaaacaggaaacncccctaagctcngatctatgctgaatccactttgacaaagtcggtccccatcaaggtcagtgcngtgatcgtgggacagatttcactctaaccatcagcgtctgcaacctgaagtatttagactaactctactactagtacaacagacgtagacagacacgcctacactaacgtttcggacggaacggaccgaaggtgaagaacgtacaaaacgactagtacggctgacc

SEQ ID NO: 307033 - DNA, 526 bp, Homo sapiens
  misc_feature: GZ8MTXP02F3PJS.3.20.B09.1.454.CMB.2.raw
  modified_base (465)..(465): a, c, t, g, unknown or other
  misc_feature (465)..(465): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttatactggagctgctccggcagcccccagggaaggactggagcatattgggtatgtctttcacagtggagactgactacaacgcctccctcgacggagtccgggtcaccgatactcgagtagacacgtaccaagacgccagttcctccctgaaacgctgaggctgtgagcgccgcagacacggccgtgtattactgtcgcgagacgtggccgacaaaccnggactaacgggtggcaactcctatcgtctttgaatatcgtgggacctaagggacaagtcgg

SEQ ID NO: 307034 - DNA, 515 bp, Homo sapiens
  misc_feature: GZ8MTXP02J2JCY.3.20.B09.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (272)..(272): a, c, t, g, unknown or other
  misc_feature (272)..(272): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcgtctatttaaattggtatcagcacaaaccaggaaacncccctaagctctgatctatgctgaatccactttgacaaaggtcggtccccatcaaggttcagtggcagtgatcgtgggacagtatttcactactaacatcagtcgtctgacaactagaagtattttagactaactactactactcgtacaacagtagngacacgacaccncctacactacgttacgggcggaacgggaccgaacgggtagaagaactaacgaaacgaactgtacggcacgacc

SEQ ID NO: 307035 - DNA, 536 bp, Homo sapiens
  misc_feature: GZ8MTXP02IUHAI.3.20.B09.1.454.CMB.2.raw
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcgttntatttaaattggtatcagcacaaacagggaaacnccctaagctcctgactctatgctagaacttccatttgactaaaggtcgggtccccatcgtaaggttcagtcggcaggtgatcgtaggacagtactttcactctaacatacagtacgtctacgactaaccgtagaagtacttttacgacttactactatactagtaaccaagagagtacgaacacgacacgcctacactacgtttcggacggacggtaccgaaggtacgagtaagtaacgaaacgtaactggtacgcgtacgacc

SEQ ID NO: 307036 - DNA, 567 bp, Homo sapiens
  misc_feature: GZ8MTXP02J2COO.3.20.B09.1.454.CMB.2.raw
  modified_base (310)..(310): a, c, t, g, unknown or other
  misc_feature (310)..(310): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccagggaaggactggagcatattgggtatgtctttnacagtgggaggactgactacaacgcctcctcaggacgtcgggtcaccgatatcagtagacacgtacaagacgccagtcctccctgaacgctgagggctgtgagcgccgcagacgacggcgtgtacttacgtgtgcggacgacgtcgggcccgacgaaaaccgacggtaaccgtacggggtcggacctaaaccgttccctaagtcggttccttttaggaattacgtcggtacggggaccaaggggacctaagttccgg

SEQ ID NO: 307037 - DNA, 734 bp, Homo sapiens
  misc_feature: GZ8MTXP02GUN7A.3.20.B09.1.454.CMB.2.raw
  modified_base (269)..(269): a, c, t, g, unknown or other
  misc_feature (269)..(269): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagaatagcgtctattaaattggtatcagcacaaaccaggaaancccctaagctcctgatctatgctagaatcctacttttgactaaaaggtcggggtaccccagttaccgtaaagggtttccaaggttggggaccgtaagggtggggaattccggttagggggaaacctagggtaactttttaccaaccttaaccttaaaaccctaatttaccgaaacgggtcccgggtttacccttcgggaaccctaaaacccgttagggtaaaacggttacgttttttacggaaccttaaaccctttacctaaaccctttaaccttacggttaaccaaaacgaacggtaagttacggaaaccaacggaccccaaccggtaccctaccctaaacgttaccggttttacgggtacgggggtaaacggggtaacccgtaaaacggggttacgggaagtaaacgtaaccgaaaaacggtaaaccgttacgggtacggtaccgttacggaacctaaacccg

SEQ ID NO: 307038 - DNA, 551 bp, Homo sapiens
  misc_feature: GZ8MTXP02GI3TH.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttacactggagctggctccggcagcccccagggaaggactggagcatagttgggtatgtctttcacagtgggagactgactacaacgcctccctcacggacgtcgggtcaccgatatcagtagacacgtccaagacgccagttcctccctagaacgctaggacgggctggtgacgcgccgcagacgacggccgtgtattacgtgtgcgagactggaccgacaacgagacctacgggtcgacaaactccgtaagtcgtacttttagaagttacgtcgtcgggggacccaaggggtaccaagttccgg

SEQ ID NO: 307039 - DNA, 609 bp, Homo sapiens
  misc_feature: GZ8MTXP02HI043.3.20.B09.1.454.CMB.2.raw
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccgagggaacggactggagcaatatgggtatgtctttcacaggtgggagactgactacaacgcctcctcaggagtcggtcacatancagtagacacgtaccaaagancctagttcctcccgtgaaacgcgtggagggctgtgacgccgccgcaaggaccacgggccgttagtactttaccgtggtcgcggaagaccgtcggacccgacaaaacgtagtaaccgtaacgggttcggaacctaaaccttcccgttaagtcccggttacgtttttaggaactttaacgttccgggtacgggggaaccccgaaaaggggtaacctaaaaggtttccggg

SEQ ID NO: 307040 - DNA, 536 bp, Homo sapiens
  misc_feature: GZ8MTXP02G4D9B.3.20.B09.1.454.CMB.2.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (352)..(352): a, c, t, g, unknown or other
  misc_feature (352)..(352): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctaatttaaatggtatcagcaacaaaccaggaaacncccctaagctccngatctatgctagaactcctactttgacaaaggtcggggtaccccagtactaaggttcaggtggacnggtgatcgtgggacagtatttcactctaacatcagcgtctcgactaacgtagaagtatttagactaactactactactagtacaacgtagacgtagacagacacgcctacacgtacgttacgggacggtaacggaccgaagggtacgaagaactaacgaaacgtacgtaggtcggactcgaacc

SEQ ID NO: 307041 - DNA, 566 bp, Homo sapiens
  misc_feature: GZ8MTXP02I9KOL.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgccccagggaaggactggagcatagttgggtatgtctttcacgaggtgggagactgactacaacgcctcctcacggacgtcggtcaccatactcagtacgacacgtccaagacgacctagttcctccctgaacgtctggaggctggtgacgccgccgcacggaccacggccgttagtacttacgtgtcgacggagacgtcggacccgacgaaacgagtaccgtacgggtcggacctaaacttcctagtcgttcttttagaattacgtcggtacggggacctaagggacctaagtcgg

SEQ ID NO: 307042 - DNA, 533 bp, Homo sapiens
  misc_feature: GZ8MTXP02HOQUY.3.20.B09.1.454.CMB.2.raw
  modified_base (441)..(441): a, c, t, g, unknown or other
  misc_feature (441)..(441): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttacactggagctggctccggcacgcccccagggaaggactggagcatattgggtatgtctttcacagtgggaggactgactacaacgcctcctcacggagtcgggtcaccatatcagtagacacgtccaagagccagttcctccctagaacgctggaggctgtgagcgccgcagacgacggccgtgtattacgngtcgcgagactcggccacgaaacgagactaacgggtgacaaacgtcctatcgtcttttgaattagtcgtcggggacctaagggactaagtcg

SEQ ID NO: 307043 - DNA, 499 bp, Homo sapiens
  misc_feature: GZ8MTXP02IK7MO.3.20.B09.1.454.CMB.2.raw
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggttccagatgtgacatcctgatgacccagtctccatcctccctgtctgcatctgtaggagacagagtcaccatcacttgccgggcaagtcagggcatcagcagctattaaatggttcagcagagatcagggaancccctaagctcctgatacatggtncatcacgtttacaaagtgtcgtcccatctaaggtttagtggcagtggatcgtggggacaggagttcactctacaccatccacctagtctagccaaacctgaagtattttgctaaacttactactgtacaacagattacactacgtcctcggtctacgttcggcggcgggacaggtcgacgtcagaacgaacgtgtacgctcgcactc

SEQ ID NO: 307044 - DNA, 555 bp, Homo sapiens
  misc_feature: GZ8MTXP02GBIMC.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaacggactggagcatagttggtatgtctttcacagtgggagactgactacaacgcctcctcacggacgtcgggtcaccgatatcagtacgacacgtaccaagacgaccagttcctccgtagaacgcgttaggagggctggtgacgcgaccgcgacgaccgacggtccgttagttagttacgtgtacgcgaagcgtggccgacaaacgagacgtacggtgacctaactctatcgtctttagaagttctacggtcgggacctaagggactaagtcgg

SEQ ID NO: 307045 - DNA, 540 bp, Homo sapiens
  misc_feature: GZ8MTXP02HOBHX.3.20.B09.1.454.CMB.2.raw
  modified_base (260)..(260): a, c, t, g, unknown or other
  misc_feature (260)..(260): n is a, c, g, or t
  modified_base (424)..(424): a, c, t, g, unknown or other
  misc_feature (424)..(424): n is a, c, g, or t
  modified_base (463)..(463): a, c, t, g, unknown or other
  misc_feature (463)..(463): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccagggactggtgaagccttcggagacccctgtcccctcacctgcactgtctctggtgctccatccgtccttactactgganctggctccggcacgcccccgagggaaggactggagcatatgggtatgtctttcacaggtggagactgactacaacgcctcctcaggagtcgggtcaccatatcagtacgacacgtaccaagacgcccagttcctaccctgaaacgctgaggctgtgagcgcganagacacgggcgtagtattactgtgcgaagcgtggccganaacgagacgtaggtcggactaaactcctaagtcgttctttaagtagtagtacgtacgggacgaacggaacgtaaagg

SEQ ID NO: 307046 - DNA, 521 bp, Homo sapiens
  misc_feature: GZ8MTXP02FOJMC.3.20.B09.1.454.CMB.2.raw
  modified_base (353)..(353): a, c, t, g, unknown or other
  misc_feature (353)..(353): n is a, c, g, or t
  modified_base (417)..(417): a, c, t, g, unknown or other
  misc_feature (417)..(417): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaatggtatcagcaacaaaccgagggaaagcccctaagctcctgatctatgctagaactcctactttgacaaaggtcggggtacccccatcaaggttcagtggcaggtgntcgtgggacagtactttcaactactaaccatcagtcggtctgactaacctagtaagtattttanctaaactcactactcgtacaacagagtgacagacacgctacactacgttcggacggacggaccgaaaggtggaagaacgtacgaaacgtactagaggctagacc

SEQ ID NO: 307047 - DNA, 591 bp, Homo sapiens
  misc_feature: GZ8MTXP02HPH6A.3.20.B09.1.454.CMB.2.raw
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacgttgccggcaagtcagagctattagcgttactatttaaagttggtatcagacaacaaaaccgaggaaacncccctaagcctccngatctatcgactagtaaactcctaacgtttgactaaaggtcggtacccccagtacgtaaggtttcaggtcggacgtggtggaatcggtaggggaactagtactttccacttactaaccatacgacgtcggtctagactaacgtagaacgtatttacgactactactactactgtaacaacgagtagtacgacgacgccgtaaccgcctacgtaccgtaccggtttacgggacggggtaacgggtaccgagggtacggaacgtaacgtaacgaaaacgtacgtaggcgtacgtcgac

SEQ ID NO: 307048 - DNA, 487 bp, Homo sapiens
  misc_feature: GZ8MTXP02JYPE8.3.20.B09.1.454.CMB.2.raw
tcagagacgcactccacgaccggtgctcgatttagtgtagtgtgaaggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccaggaaagcccctaagctcctgatctatgctgaatccatttgcaaagtgggtccccatcaaggttcagtgcagtggatcgtgggacagatttcactctaaaccatcagcgtctgcaacctgagtatttgacaactcactactgtacaacagagtagacagcacgcctcactacttcggacggacggaccgaaggtggaagaatacgaaacgactgtcggctgacc

SEQ ID NO: 307049 - DNA, 539 bp, Homo sapiens
  misc_feature: GZ8MTXP02GDAIM.3.20.B09.1.454.CMB.2.raw
  modified_base (339)..(339): a, c, t, g, unknown or other
  misc_feature (339)..(339): n is a, c, g, or t
  modified_base (382)..(382): a, c, t, g, unknown or other
  misc_feature (382)..(382): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggagggactggagcatattgggtatgtctttcacagtgggaggactgactacaacgcctccctcaggagtcgggtcaccatatcagtagacacgtccaagagccagttctccctgaagctgagggctgtgagcgccgnacgacacggccgtgtattacgtgtgcgagactggccgcaaacngactacggtggcaactcctatgctttgatatcgtgggaccaagggacaagtggtcaccggtctcttcacgcctccacctaacggcccagtccgtccttccccctcggccacccgtcctccaacgacgcacctcgtcgggggccacgacgcggcccgg

SEQ ID NO: 307050 - DNA, 537 bp, Homo sapiens
  misc_feature: GZ8MTXP02JMYUQ.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccagggaaggactggagcatattgggtatgtctttcacagtgggagactgactacaacgcctccctcacggacgtcgggtcaccatactcagtagacacgtccaaagacgccagttcctccctagaacgctggagggctggtgagcgccgcagacacggccgtgtacttacgtgtgcgagacgtggccgacaaacgagactacgggtggaccaactctactcgtcttttagaattactcgtacgggaccaagggacaagtcgg

SEQ ID NO: 307051 - DNA, 564 bp, Homo sapiens
  misc_feature: GZ8MTXP02I6MYN.3.20.B09.1.454.CMB.2.raw
  modified_base (322)..(322): a, c, t, g, unknown or other
  misc_feature (322)..(322): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccattcccgtccttactactggagctggctccggcacgcccccgagggaggactggagcatagttggtatgtcttcacaggtgggngactgactacaaccgcctcctgacggagtcggcaccatactcagtagacacgtaccaagacgacctagttcctacccgtagaacgcgtaggagggtctggtgaacgccgccgcacggacgacggcgtagtattacgtgtcgcgtagcgtcggccgacaacgacgacgtacggacggaccaaacgtccttatcgtcctttagaacgtacgttcgacggggtaccaacggggacctagtaccgg

SEQ ID NO: 307052 - DNA, 597 bp, Homo sapiens
  misc_feature: GZ8MTXP02JWPPA.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtccttactactggagctggctccggcacgcccccgagggaaggactggagcatagttggtatgtctttcacaggtgggagactgactacaaccgcctccgtcacggacgtccgggtcaccatactcagtacgacacgtaccaagacgccagttcctccctagaacgcgtggacgggctggtgacgccgccgcgaagaccgaccgggccgttgtaacgttaccgtggtagcggaacgacgtcggacccgacaaacgcggtacgtaccgggtcgaccgtaaaccttccgtaacgtcggttaccttttagaacgttacgtccggtacggggaccgaaaggggtacctaagttccggg

SEQ ID NO: 307053 - DNA, 534 bp, Homo sapiens
  misc_feature: GZ8MTXP02FS7QB.3.20.B09.1.454.CMB.2.raw
  modified_base (449)..(449): a, c, t, g, unknown or other
  misc_feature (449)..(449): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcacgcccccgagggaacggactggagcatattgggtatgtctttcacagtgggagactgactacaacgcctccctcacggagtcgggtcaccatatcagtagacacgtaccaagagccagttcctaccctgaaacgctggagggctgtgacgcgccgcagacgacggccgtgtacttacgngtgcgagctcggccgacaacgagactacgggtgcaaacgtcctatcgtctttagaatagtcggtgggaccaagggactaagtcgg

SEQ ID NO: 307054 - DNA, 519 bp, Homo sapiens
  misc_feature: GZ8MTXP02JS6JK.3.20.B09.1.454.CMB.2.raw
  modified_base (429)..(429): a, c, t, g, unknown or other
  misc_feature (429)..(429): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtgctccatccgtcttactactggagctgctccggcagcccccaggaggactggagcatattgggtatgtctttcacagtggaggactgactacaacgcctcctccagagtcgggtcaccatatcagtagacacgtccaagagccagttctccctgaagctgagggctgtgagcgccgcagacacggccgtgtattacngtagcgagactggccgcaaacacgactacggtggacaactcctaatggtccttttgacttactacgtggggacccaaaggggactaaagg

SEQ ID NO: 307055 - DNA, 528 bp, Homo sapiens
  misc_feature: GZ8MTXP02HIG0X.3.20.B09.1.454.CMB.2.raw
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactgagctggctccggcagcccccagggaaggactggagcatatggtatgtctttcacagtggagactgactacaacgcctcctcacggagtcgggtcaccatactcagtagacacgtccaaagagccagtctcctgaanctgagggctgngagcgccgcagacacggccgtgtattacgtggtgcggtagacgtcgggccacgaaacagacgtacggtcggaccaaacgtcctacgtgtccttttgaacttncgtcgggacctaacggacaaagtcgg

SEQ ID NO: 307056 - DNA, 586 bp, Homo sapiens
  misc_feature: GZ8MTXP02IWPX1.3.20.B09.1.454.CMB.2.raw
  modified_base (313)..(313): a, c, t, g, unknown or other
  misc_feature (313)..(313): n is a, c, g, or t
  modified_base (405)..(405): a, c, t, g, unknown or other
  misc_feature (405)..(405): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctccagatgggtcctgtcccaggtgcagctgcaagagtcgggcccaggactggtgaagccttcggagaccctgtccctcacctgcactgtctctggtggctccatccgtccttactactggagctggctccggcacgcccccagggaaggactggagcatattgggtatgtcttcacgngtgggagactgactacaacgcctcctcacggagtcgggtcaccgatatcagtacgacacgtaccaaagacgccagttcctccctaggaaacncgtggagggtctggtgacggcgacccgcaaggacacggccgtgttactacgtgtgcgagtcgtggccgacgaaccgagtaaccgtaggtcggacctaaacttcccgttaagtcgttcgtttttagaacgtttacgttaccggttacgggggacccgaaaaggggtacgtaaaagttccggg

SEQ ID NO: 307057 - DNA, 576 bp, Homo sapiens
  misc_feature: GZ8MTXP02FVY1W.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccagggaaggactggagcatattgggtatgtctttacacagtgggagactgactacaacgcctcctgacggacgtcggtacaccgaatactacgagtacgactacgtacccaaagacgtaccagttcctaccctagaacgcgtaggagggtctggtacgagccgccgctacgaccgacggtccgttagtacttacgtgtacgcgaagctcgggccacaaacgagaaccgtacggtacggacctaacctactacgtcggtctttagaacttacgtcgtcggggacctaagggacctagttacgg

SEQ ID NO: 307058 - DNA, 516 bp, Homo sapiens
  misc_feature: GZ8MTXP02H0I91.3.20.B09.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (341)..(341): a, c, t, g, unknown or other
  misc_feature (341)..(341): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttggccggnaagtcagancattagcgtataatttaaatgtatcagacaacaaacgaggaaacncccctaagctctgatctatgctgaattcatttgacaaaggtcgggtaccccatcgaagttcagtgcngtgatcgtggactagactttcactactaaaccatacagcggtctcgacaactagagtattttagactaactactactactgtaccaaagagtagtacgacagacactctactacgtacgttacggacggacggacgaaggagaagaacgtaacgaaacgacgtagacgctacgcg

SEQ ID NO: 307059 - DNA, 584 bp, Homo sapiens
  misc_feature: GZ8MTXP02GSR0L.3.20.B09.1.454.CMB.2.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggactggagcatattgggtatgtctttcacagtgggagactgactacaacgcctccctcaggagtcggtcaccatatcagtagacacgtccaagagccagttcncctgaagctgagggctggtgagcgccgcacgacacggctgtattacngtgcgagacgtcggccgacaaacgtagaacgtacggtcggacaacttccctaagtgtcttttagattacgtcgttcggggaccgtaaagggaacaaagttcgtaccgtaccgtcttccttcgacgtccctaccacccgaacgggcccaacgtccggtccctcccccgtcggccctacccgtcctacccaacgacgaaccaccgtccgtcggggcacgacgccggcccg

SEQ ID NO: 307060 - DNA, 601 bp, Homo sapiens
  misc_feature: GZ8MTXP02IQ2NE.3.20.B09.1.454.CMB.2.raw
  modified_base (277)..(277): a, c, t, g, unknown or other
  misc_feature (277)..(277): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcgttctaatttaaattggtatcagcaacaaaccagggaaacncccctaagctcctgactctatgctgctatcctactttcgactaaacgtcgggtacccatccgaggttcaggcggcgaggggtactcgtagggactagtatttcactctcacatcancacnctgacagctagtaattagtttacgaacctaactttactagttcgtacaactacggtaacttaacttacgttttacccttaacgtttaccgttaccggtaaccgaaacgggggtaacctaaacgggtaccgttaaggggtaacgtaaaacggttaaaaccgtaaccgttagggttacggacgttacggtaccctaaaccttaccg

SEQ ID NO: 307061 - DNA, 543 bp, Homo sapiens
  misc_feature: GZ8MTXP02II2PC.3.20.B09.1.454.CMB.2.raw
  modified_base (195)..(195): a, c, t, g, unknown or other
  misc_feature (195)..(195): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttggccgggcaagtcagagcattagcgtctaatttaaattggtatcagcaacaaaccgaggaaacgcccctaagctcctgatctatgctagaactcctactttgacgtaaaggtcggggtacccccagtacgtaaggttcaggtggctaggtggatcgtagggactagtatttcactactaacctatcagcgtctcgacaactagaagtatttgactaactctaactactagtacaacgagagtcgaacagacacgcctacactccgttcgggacggtaacgggaccgaaaggtggaagtaacgtacgaaacgtacgtggtacgctacgacc

SEQ ID NO: 307062 - DNA, 551 bp, Homo sapiens
  misc_feature: GZ8MTXP02HAXIJ.3.20.B09.1.454.CMB.2.raw
  modified_base (247)..(247): a, c, t, g, unknown or other
  misc_feature (247)..(247): n is a, c, g, or t
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
  modified_base (494)..(494): a, c, t, g, unknown or other
  misc_feature (494)..(494): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttanactggagctggctccggcacgccccgagggaaggactggagcatagttggtatgtctttcacgagtggagactgactacaacgcctccctnacggacgtcggtcaccatactcagtagacacgtacaagacgaccagttcctcccgtagaacgtcgtaggaggtcttggngacgccgccgacagaccacgtaccgtagttaacttacgtgtcgcgaagcgtcggccgacgaacgacgtacgtacggnggacctaaactcctagtcgtctttagaattagtcgtacgggacaacggactaagtcg

SEQ ID NO: 307063 - DNA, 533 bp, Homo sapiens
  misc_feature: GZ8MTXP02JXNZ0.3.20.B09.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (493)..(493): a, c, t, g, unknown or other
  misc_feature (493)..(493): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctcctgtctgcatctgtagganacagatcacatcacttgccgggnaagtcagagcattagcgtctattaaatgtatcagcacaaaccagggaaacncccctaagcctcctgatctatgctagaactcctactttgactaaaggtcggggtcccccatcgaaggttcagtggcagtggatcgtgggactagtatttccacttactaaccatcaggcggtctcgactaacctgaacgtattttgactaactcactactcgtacaacacggagtcgaacacgcaaccgcctacactacgttcgggacggacgggacctaagggnggagaagtaccaaaacggactaggtcggacgtacgacccg

SEQ ID NO: 307064 - DNA, 574 bp, Homo sapiens
  misc_feature: GZ8MTXP02FUIGQ.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcacgcccccgaggggaagggactggagcagtagttgggtatgtctttcacgagtgggagactgactacaacgcctcctcacggagtcggtcaccatatcagtacgacacgtaccaagacgcctagttcctccctagaacgctggagggtctggtgacgccgccgcacgaccgacggccgtagttacttaccgtgtacgcgagacgtcggaccgacaaacgagaccgtacgggtggaccaaaccttcctaagttcgtacgtttttagaacttacgtcgtacgggggaccaaaggggtacaagttcgg

SEQ ID NO: 307065 - DNA, 580 bp, Homo sapiens
  misc_feature: GZ8MTXP02HM6EX.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtccttactactggagctggctccggcacgcccccgagggaaggactggagcattagttgggtattgtctttcacgagtgggagactgactacaacgcctcctcacggacgtcgggtcaccatatcagtagacacgtaccaagacgcctagttcctccctagaagcgtaggagggtctggtcgacgcgccgcgaaggaccgacgggcccgttagtactttacgtgtgacgagacgtcgggccgacaaacgacgaccgtacgggtggacctaaacgttcctaagtcgttacttttagaattacgtccggtacgggggaacctaacggggactaacgttcgg

SEQ ID NO: 307066 - DNA, 567 bp, Homo sapiens
  misc_feature: GZ8MTXP02FNR6Y.3.20.B09.1.454.CMB.2.raw
  modified_base (439)..(439): a, c, t, g, unknown or other
  misc_feature (439)..(439): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactgagctggctccggcagcccccaggggaaggactggagcatattgggtatgtctttcacagtgggaggactgactacaacgcctcctcacggagtcgggtcaccatatcagtagacacgtaccaaagagccagttctccctgaagctgagggctggtgagcgaccgcgagacacggccgtgtattacngtcgcgagtacgtcggccgacaaacgagaactacgggtaggacccaaacttcccgtaattcggtctttttaggaattaacgttcggttacgggggaccccgtaaaagggggaacctaaagtttacggg

SEQ ID NO: 307067 - DNA, 571 bp, Homo sapiens
  misc_feature: GZ8MTXP02H3H7N.3.20.B09.1.454.CMB.2.raw
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgcccccgagggaaggactggagcatattgggtatgtctttcacaggtgggagactgactacaacgcctccctcgaggagtcggtcaccatatcagtagacacgtaccaagacgcctagttccnccctagaacgctggagggctgtgacgcgccgcacgacgacggcgtgtattacgngtgcgagacgtgggaccacaaacagacgtacggtgacactctatgtctttgatatcgtacggggcgaaagggactaagtcggtacaccgtcttctacacgtcctacaccgacggcccacgtccgtacccttcccgcgcctaccctacctaccgacgacgaaccgaccgtacggtcggggacaccgacggcccggtcccgg

SEQ ID NO: 307068 - DNA, 675 bp, Homo sapiens
  misc_feature: GZ8MTXP02G9SPM.3.20.B09.1.454.CMB.2.raw
  modified_base (194)..(194): a, c, t, g, unknown or other
  misc_feature (194)..(194): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccatcacttggccgggcaagtcagagctattagcgttacttaatttaaagttggtatcagacaacaaaccgaggaaacgcccctaagctcctagactctatgctagaacttccctactttagacgtaaacgggttcggggtacccccctagttaccgtaaacgggtttcaaggggttgggacctaggggttacgggaacgttcgtacgggggtaacctaagggttaactttttacccaaaccctttaccttaaaaccctaattcccgaaggtcccgggtttacctacggaccctaaacccgttagggtaaaaccgtttatttttacggaacccttaaacttcccgtaaacttaacttcggttaaaccaaccgtaaggtacgtagaacacgaccaccgtaccctacgaccgtcgttacggacggtacgggacgagggagtacgaactacgaaacgcgtagcggtactagacc

SEQ ID NO: 307069 - DNA, 592 bp, Homo sapiens
  misc_feature: GZ8MTXP02F60MN.3.20.B09.1.454.CMB.2.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggactggagcatattgggtatgtctttcacagtggaggactgactacaacgcctccctcaggagtcggtcaccatatcagtagacacgtccaaganccagttctccctgaagctgagggctgtgagcgccgcacgacacggccgtagtattacngtgcgagacgtgccgcaaacagactacggtgacgaactcctaatgtctttgatatcgtcggggtaccgaaagggactaaagtggtactaaccggtcctccttcacgtccctaccacccgaaacgggccctaacgtccggtaccctttcccccgtcggtccctaacccctcccttacccaacgaccgaacccgacccgtccgtacgggggccaaccgacggcccggtccccggg

SEQ ID NO: 307070 - DNA, 555 bp, Homo sapiens
  misc_feature: GZ8MTXP02FVX7H.3.20.B09.1.454.CMB.2.raw
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
  modified_base (518)..(518): a, c, t, g, unknown or other
  misc_feature (518)..(518): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacaggtgggaggactgactacaacgcctccctcaggagtcgggtcaccatatcagtagacacgtccaagagccagttcnccctgaagctgagggctggtgagcgccgcacgacacggccgtgtattacngtgcgagactgggccacaaacgagactacggngacaactcctatgcttttgatatcgtgggccgtaagggacaagtggtcaccgtctcttcncgcctccaccgtaacgggccctagtccgtccttccccctcggccaccctcctacccacggacnccgacccgtcgtcgggggccacgaccgccggtcccgg

SEQ ID NO: 307071 - DNA, 620 bp, Homo sapiens
  misc_feature: GZ8MTXP02HR2P1.3.20.B09.1.454.CMB.2.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccatccctcctgtctgcatctgtagganacagagtcaccatcacttggaccgacaagtcagagctattagcgttacttaatttaaagttggtatcagacaacaaaccgaaggaaacncccctaagcctccagatctatgctagaactcctatttgaactaaaggtcgggtacccccatacgtaaggttcaggtggctgtaggatcggtagggactagtactttaccaactactaaacctatacgacggtcgtactacgtacctaaaccgtagtaaagttagtttacgacctaaactactaactacgtacgtaaccaagtagagtacgaacgacgaccaaccgtaccctaccgtaaccgttaccggttacgggaaccggggtaacgggtaacccgaaaggggttacggaacgtaacgtaaaccgaaaacgtaccgtaggtacgcgtacgaccc

SEQ ID NO: 307072 - DNA, 606 bp, Homo sapiens
  misc_feature: GZ8MTXP02IA1J5.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggccaggactggtgaagccttcggagaccctgtccctcacctgcactgtctctggtgctccatccgtccttacactggagctggctccggcacgcccccgagggaacggactggagcagtagttgggtatgtcttcactaggtggagactgactacaacgcctcctcgacggtacgtcgggtcactatactcagtagacacgtaccaaagacgccagttcctcccgtagaacgcgtaggacgggtctgggtcgggccgaccggcgaacgaccgacggtccgtagttacgttacgtgtcgcgacgacgtcggccgacaacgacgaacgtacgggtacgaccaaacttcccttaagtcgttaccgtttttagacgttaacgtttcgggtacggggaacccgtaaaaggggtacctaaacggttcggtaacccg

SEQ ID NO: 307073 - DNA, 613 bp, Homo sapiens
  misc_feature: GZ8MTXP02GESCS.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttacactggagctggctccggcacgccccgagggaaggactggagcatagttgggtatgtctttcacgtaggtgggagactgactacaacgcctcctacgacggagtcggtacaccatactcgagtacgacaaccgtaccgaaagacgaccctacgtttacctcccgttagaaacgtccgtaggacggggtctggtacgacgccgcccgacgaacggaccgaccgggcccgttagttaacttacgtagtcgcgagacgtcggaccgacgaaacgacgaacgtacgggtcgacctaaaccgttcctaagttcgtactttttagaacgttacgtcggtacggggtaccgaaaggggtactaagttaccgg

SEQ ID NO: 307074 - DNA, 572 bp, Homo sapiens
  misc_feature: GZ8MTXP02JQRI5.3.20.B09.1.454.CMB.2.raw
  modified_base (487)..(487): a, c, t, g, unknown or other
  misc_feature (487)..(487): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtcttacactggagctggctccggcacgcccccgagggaacggactggagcatagttgggtatgtctttcacgtagtgggagactgactacaaccgtccctccgtcgacggacgtcgggtacaccgatatcagtagacacgtaccaagacgacctagttcctaccctaggaacgcgtaggacgggtctggtgacgccgccgacgaacggaccgacgggtccgtgttacttagttgtcgacaacgngtcgcggtatacgcgcgaggccggcctagcttcgtcttttagagttaacgtcggtacggggacccgaggtactcgtacggtcccg

SEQ ID NO: 307075 - DNA, 528 bp, Homo sapiens
  misc_feature: GZ8MTXP02JAFV7.3.20.B09.1.454.CMB.2.raw
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcacgcccccagggaagggactggagcatattgggtattgtctttcacagtgggaggactgactacaacgcctcctcacggagtcggggtcaccgatactcagtacgacacgtccaagacgccagttcnccctgaagctgaggctgtgagcgccgnagacacggccgtgtatactgtgcgagactggccgacaacgagactaggcgacaactctactacgtcttttagaagttatcgtcggggactacgggactaagtcgg

SEQ ID NO: 307076 - DNA, 588 bp, Homo sapiens
  misc_feature: GZ8MTXP02JIU4B.3.20.B09.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (339)..(339): a, c, t, g, unknown or other
  misc_feature (339)..(339): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttanactgganctggctccggcacgccccagggaaggactggagcatagttgggtatgtctttcacagtgggagatgactacaacgcctccctnacggagtccgggtcaccagtatcagtagacacgtccaagacgcctagttcctccctagaacgcgtgaggggctggtgacgcgccgcagacacgggtccgtgtaattacgtgtgaccgagacgtcggccgtacaaaccgagtaccgtaacgggtcggacctaaaccgtccctaagttcggttaccctttttgggaacttacgtaccggttacgggggaccctaaaacgggggtaccaaaaggtttccggg

SEQ ID NO: 307077 - DNA, 550 bp, Homo sapiens
  misc_feature: GZ8MTXP02GN7RP.3.20.B09.1.454.CMB.2.raw
  modified_base (453)..(453): a, c, t, g, unknown or other
  misc_feature (453)..(453): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggccaggactggtgaagccttcggagaccctgtccctcacctgcactgtctctggtgctccatccgtcttactactggagctggctccggcacgccccagggaaggactggagcatatggtatgtcttcacagtggagactgactacaacgcctcctcaggagtccggtacaccgtatactcagtacgacacgtaccaaagacgacctaagttcctcctagaacgctggagggtctgtgacgcgccgcgaagtaccgacggccgttgtactttacggngtacgacgacgcgtcggaccgacgaaacgacgtacgtacggacgactaactctacgtcgtctttagaatacgtacggtacggacaaggactacgtcg

SEQ ID NO: 307078 - DNA, 702 bp, Homo sapiens
  misc_feature: GZ8MTXP02HULAZ.3.20.B09.1.454.CMB.2.raw
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcacatcacttgccgggcaagtcagagcattagctactaatttaaatgtatcaagcaacaaaacgagggaaacgcccctaaagcctcctagacttctaatcgactagtaaacttcctactttgacctaaaagggttcggggtaccccccaagtaccgtaaaggttcgaagttcgggacgtagggtggtaacttcggtacgggggaactaaggttacttttaccaacttaccctaaaacccgtattaccgaacggtccggggttacctacggtacctaaaccgttacggtaaaacgttaagtttttcggaaccctaaacttaccctaaacttaccgttacgtaacctaaaacgacggtaagtacggaacaacggaccgaaccgtcccttaaccgaaccgtacccggttttaccggggaccggggtaaacgggaaccggtaaacggggtaggaacgtaaacgttaaccgaaaaacggtaacgtggttacggcttacggaaccc

SEQ ID NO: 307079 - DNA, 682 bp, Homo sapiens
  misc_feature: GZ8MTXP02HJHJC.3.20.B09.1.454.CMB.2.raw
  modified_base (319)..(319): a, c, t, g, unknown or other
  misc_feature (319)..(319): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagttgggcccaggactggtgaagccttcggagaccctgtccctcacctgcactgtctctggtgctccatccgtccttactactggagctggctccggcacgccccccgagggaagggactggagcattagttgggtattgtctttcacnggtgggagactgactacaacgcctccctgacggtacgtcgggtacaaccatactacgagtacgaacaccgtacccaaaggtacgacctaacgttccctcccgtagtaaacgcgttacgggagggtctgggtacggacgcccggccgacaacggaaccgaccggggtacccgtttaggtaactttaccggtggttacggccggtaaaggtccggtacgggcccgaaccgaaaaccgaacggtaaccgttaaccggggttcggacccgtaaacccttaccgtttaacgtcgtttaccgtttttacgaagtttacgttaccgggttacgggggacccgtaaaagggggacctaaaggtttcccggg

SEQ ID NO: 307080 - DNA, 539 bp, Homo sapiens
  misc_feature: GZ8MTXP02GL42W.3.20.B09.1.454.CMB.2.raw
  modified_base (366)..(366): a, c, t, g, unknown or other
  misc_feature (366)..(366): n is a, c, g, or t
  modified_base (501)..(501): a, c, t, g, unknown or other
  misc_feature (501)..(501): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccgaggggaagggactggagcatattgggtatgtctttcacagtgggagactgactacaacgcctccctcacggagtcgggtcaccatatcngtagacacgtaccaagagccagttctccctagaagctgaggctgtgagcgccgcagacgacggccgtgtacttactgtgcgagacgtcggccgacaaacgacgacgtacgggtaggacctaaactcctagtcgtntttacgaagttatcgtaggggtccaaaggacaagtcgg

SEQ ID NO: 307081 - DNA, 601 bp, Homo sapiens
  misc_feature: GZ8MTXP02HOPM8.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttacactggagctggctccggcacgcccccgagggaaggctggagcatagttgggtattgtctttcacgaggtgggagactgactacaaccgcctcctcgacggagtcgggtcacctatactcagtagacaccgtacaaagcgacctacgttcctacccgtagaaacgcgttaggacggggtcctggtacggacgccggacccgacgacggaaccgaccgggtccgttagttactttaccgtgtacggcgaagacgtcggaccgacaaacgacgaaccgtacgggtgaaccaacgttcctaacgtcgttcctttagaagtacgtcggtacggggaaccaggggactaacggtccgg

SEQ ID NO: 307082 - DNA, 565 bp, Homo sapiens
  misc_feature: GZ8MTXP02GUU01.3.20.B09.1.454.CMB.2.raw
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtcttactactggagctggctccggcacgcccccagggaagggactggagcatattggtatgtctttcacaggtgggagactgactacaacgcctcctnacggagtcggtcacatatcagtanacacgtccaagacgccagttcnccctagaagctggaggtctggtgacgccgccgcagaccgacgggccgttagtacttaccgtggtcgcggagacgtggcccgacgaaacgacgacgttacgggacggtaccaaacttccgtaatcgtctttttagaattacgtcggtacgggggacctaaaggggacctaaagttccgg

SEQ ID NO: 307083 - DNA, 518 bp, Homo sapiens
  misc_feature: GZ8MTXP02GKH2G.3.20.B09.1.454.CMB.2.raw
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcgtatatttaaatggtatcagcacaaacaggaacncccctaagctcngatctatgctgaactcctatttgacaaaggtcgggtacccccatcgaagttcaggtgcaggtgatcgtgggacagtacttcaactctaaaccntcgagtcgtactgactaacctagaagttatttagactaactcactactcgtacaaacagagtagacagccaacgtcctacaccgttacgttcgggacggacggtaccgaaggtgagtaagtacaaacgtacgtgacggctagacc

SEQ ID NO: 307084 - DNA, 621 bp, Homo sapiens
  misc_feature: GZ8MTXP02G4CIB.3.20.B09.1.454.CMB.2.raw
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggactggagcatattgggtatgtctttcacagtgggagactgactacaacgcctccctcaggagtcgggtcaccatatcagtagacacgtccaagngccagttccnccctgaagctggagggctgtgagcgccgnacgacacggcgtagtattacngtgcgagcgtggccacgaacagacgtacggtgacaactcctaatgtcttttgatagtcgtacggggaccaaggggacaagtggtaccaccggttctcttccgacgtccctacccaaccgtaacgggcccctaacgttcccgggttaccctttccccccggtacggtacccctacccccgttacccgtacccgtaaaacggtaccgaaccctaaccccgtccggtacgggggacccaaccgaccggcccgggtaccccggg

SEQ ID NO: 307085 - DNA, 671 bp, Homo sapiens
  misc_feature: GZ8MTXP02IMWFO.3.20.B09.1.454.CMB.2.raw
  modified_base (279)..(279): a, c, t, g, unknown or other
  misc_feature (279)..(279): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggacaagtcagagcaattagcgtactaattaagttggtatcagacaacaaaccgaggaaacnccctaagctcctgatctatgctagaactcctactttagacgtaaaggtcgggtacccccagtacgaaggttcaaggtcggactagggtggtactcggtaggggaacctagttactttaccaacttacctaaacctactcgaacggtccggttctacgtaccgtaaaccgtaggtaaattacggtttacaacctaaaccttaactaaccgttaacttacggtaaaccaaacgtaaggttaacgtacgaacgaaccggacaacccgtaccctacgtaacccgttaaccgggtttccgggaacggggttaaaccgggaaccggtaaaggggttacggaacgtaaacggttaaccgaaaaacgggttaaccgtgggtacggtacgttacgaacccg

SEQ ID NO: 307086 - DNA, 689 bp, Homo sapiens
  misc_feature: GZ8MTXP02F03EJ.3.20.B09.1.454.CMB.2.raw
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgcccccgagggaaggactggagcatagttgggtatgtctttcacaggtgggaggactgactacaaccgccctccagaggtacggtcggtaccacctatactacgtaagtacgaccgtaccgtaaccgaagaccgtaccgtacgtttccctcccgtagaacgtcgtagggacgggtctggtagacgccgccgacgacgaccgccggtcgtagttactacgtgcgacgacgtacgccggccgaacaacgagtaccgtacggtcgaacctaaccttctagttcgtttctttagaattcgtcgggtacgggaaacggtaaggaactaacgggtcgtacccgtaccgttcttaccgtacgtaccgtacccctacccgaaccgggtaacccggtccctaccggttcccggttcccccttccccggcgtaccccctacccctcccgtaaccgacgtaccgcccgtaccgtcggggaccggaccacggccggtcccggtccgg

SEQ ID NO: 307087 - DNA, 569 bp, Homo sapiens
  misc_feature: GZ8MTXP02IZL4F.3.20.B09.1.454.CMB.2.raw
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactacnggagctggctccggcacgcccccgagggaaggactggagcatagtttgggtatgtctttcacgaggtgggngactgactacaacgcctcctcacggagtcggtcaccatactcagtacgacacgtaccaaagacgaccagttcctccctagaacgctaggagggtcctgtcggacgcgacccgcgtacgacgacggccgtagtacttacgtgtagcgaggacgtggcccgacaaacgacgacgtacgggtacgacaaacctctaacgtcgttctttagaattactcggacggggacaaacggggactaagtaccgg

SEQ ID NO: 307088 - DNA, 589 bp, Homo sapiens
  misc_feature: GZ8MTXP02GTE3V.3.20.B09.1.454.CMB.2.raw
  modified_base (255)..(255): a, c, t, g, unknown or other
  misc_feature (255)..(255): n is a, c, g, or t
  modified_base (372)..(372): a, c, t, g, unknown or other
  misc_feature (372)..(372): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactgganctggctccggcacgcccccgagggaacggactggagcatagttgggtatgtctttcacagtgggagactgactacaacgcctccgtcgaggacgtcgggtcaccgatactacagtanaacacgtaccaagacgcctagttcctcccgtagaacgcgtggagggtctggtagacgccgccgcgaacgaccgaccggccgttgtacttacgtgtcgcgagacgtcggaccgacgaaacgacgtacgtacgggtcggacctaaacgtccgtaacgtcgttccttttaggaatttacgtcggttacggggacccgtaaaagggtaccgtaagttccgg

SEQ ID NO: 307089 - DNA, 629 bp, Homo sapiens
  misc_feature: GZ8MTXP02F7Z7H.3.20.B09.1.454.CMB.2.raw
  modified_base (369)..(369): a, c, t, g, unknown or other
  misc_feature (369)..(369): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtccttactactggagctggctccggcacgcccccgagggaaggactggagcatagttggtatgtctttcacaggtgggagactgactacaaccgcctccctcgacggagtcgggtcaccatactcngtagacacgtaccaagagccagttcctcccgtagaaacgcgtaggagggctaggtgacgccggccgcgaggaaccgacggtcccggttagttatttaccgtggttacggcgaacggaccgttcggggacccgacgaaaaccgacggtaaacgttaccgggggtacggacctaaaccgtacctttaacgttcgttacctttttaggaatttaacgtccggttacgggggacccgtaaaagggggaacctaaggtttaccgg

SEQ ID NO: 307090 - DNA, 528 bp, Homo sapiens
  misc_feature: GZ8MTXP02GPFPN.3.20.B09.1.454.CMB.2.raw
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccaggaaagcccctaagctcctgatctatgctgaatcactttgcaaagtggggtccccatcaagtcagtgcngtgatcgtggactagntttcactctaaccatcagcggtctgacaacctaaagatttgactaactcactactgtacaanagagtnacaagcacgcctacactaccgtttcgggacgggtacgggaccaaacggggtacggaacgtaagtaacgaaaaccggaacgttacgggtacggacgttacgacctaacccg

SEQ ID NO: 307091 - DNA, 556 bp, Homo sapiens
  misc_feature: GZ8MTXP02JFCY4.3.20.B09.1.454.CMB.2.raw
  modified_base (371)..(371): a, c, t, g, unknown or other
  misc_feature (371)..(371): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccagggaacggactggagcatagttgggtatgtctttcacagtgggaggactgactacaacgcctccctcacggagtcgggtcaccatactcagtanacacgtaccaagacgccagttcctccctgaacgctgagggctggtgagcgccgcagaccacgggccgtgtacttactgtcgcgaggactcgggaccgacaaacgacggtacgtacgggtggacctaaacctccttatcgtcttttaggaattacgtcggtcggggaccgtaagggactaagtcgg

SEQ ID NO: 307092 - DNA, 621 bp, Homo sapiens
  misc_feature: GZ8MTXP02F5ER6.3.20.B09.1.454.CMB.2.raw
  modified_base (340)..(340): a, c, t, g, unknown or other
  misc_feature (340)..(340): n is a, c, g, or t
  modified_base (380)..(380): a, c, t, g, unknown or other
  misc_feature (380)..(380): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccagggaaggactggagcatattgggtatgtctttcacagtgggagactgactacaacgcctccctcaggagtcgggtcaccatatcagtagacacgtccaagacgccagttctccctgaagctggagggctgtgagcgccgnagaccacggcgtgtattacgtgtgcgagacgtggcccganaaacgagacgtacggtggctaactccttatcgtcttttagattactcgtggggacccgaaagggtaccaagttcggtacgaccgtctcgtttcgacgtccctaccaccgaaacgggcccacgttccgggttcccttcccccgttcggacccctccccgttaccccgttaccaaaccggtaccgaacccgtaacccgttccggtaccgggggtcccaaaccaccgggacccggtcccccggg

SEQ ID NO: 307093 - DNA, 615 bp, Homo sapiens
  misc_feature: GZ8MTXP02GDYOY.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaaggactggagcatagttggtatgtctttacacgtaggtggaggactgactacaaacgcctccctagacggagtccggtcacatatcagtagaacacgtaccaaagacgcctaacgttcctacccgtagaacgtcgtaggacgggtctggtagacggccgacccgacgaacggacccgaccgggtcccggttagtaactttaccggtgtaccggacggtaacgtacgtccgggacccgacgaaacgacggtaaccgtacgggaggacctaaacttcttaacgtcgtacttttgaagttcgtacggtacggggaccgtaaacggacgtaacgtcgg

SEQ ID NO: 307094 - DNA, 692 bp, Homo sapiens
  misc_feature: GZ8MTXP02HALPU.3.20.B09.1.454.CMB.2.raw
tcagagacgcactccacgaccggtgctcgatttagtgtagtgtgaagggggcaggagtcagtctcagtcaggacacagcatggacatgagggtccccgctcagctcctggggctcctgctactctggctccgaggttccagatgtgacatcctgatgacccagtcctccatcctccctgtctgcatctgtaggagacagatcaccatcacttggccgggcaagtcgagggcatcagcagtacttaatttaaattggttacagacaagagatacgaagggaaacacccctaaagcctacctagaatacagtggtgactatctaaacgtttaacaaaggttcggtaccgtaccccaagttaccgtaaaagggttttaggtcggacgtaggggttaggtaattccggtaggggaacctaaggtacgtttacccaaccttcctacccaaacctacttacccaaacccgtagtaccgtacgaaaccctaaccgtagtaaaagttacttttacgaaccttaaacctttacacttagtaaccaaacgtagttaaacgtaacctaacgttaccgtaccccgttaccgggtaccttaacccgggtttccggggccgggtaaccgggaaccggtaaagggggtcggtaaccggtacgaacggtaacccggtaaagtcgggtacgccgtacgacctaactacg

SEQ ID NO: 307095 - DNA, 577 bp, Homo sapiens
  misc_feature: GZ8MTXP02HHQ6K.3.20.B09.1.454.CMB.2.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (503)..(503): a, c, t, g, unknown or other
  misc_feature (503)..(503): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggcaagtcagagcattagcgtacttaatttaaattggtactnagcaacaaacgaggaaacnccctaagctctgatctatgctagaactcctactttgacgtaaaggtcgggtacccccatacgtaaggttcaggtggcaggtggtatcgtagggactaggtactttaccaaccttactaaaccctgtacgacggtccggttcttcgacctaaaccgttagtaaacgttacttttagaccttaaactacctaacttacgtacgtaaccaaacgtagacgtagaacncgacacgccctacacgtcgtcgggacggacggaccgaaggtgagaacgtaacgaaacgtacgtggacgctcgac

SEQ ID NO: 307096 - DNA, 583 bp, Homo sapiens
  misc_feature: GZ8MTXP02IKHQI.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgggagaccctgtccctcacctgcactgtctctggtgctcatccgtctatactgagctgctcggcacgccccgagggaaggactggagcatagttgggtatcgtctttcacgagtgggagactgactacaacgcctacctcgacggagtcggtcaccatatcagtacacacgtaccaagacgcctaagttcctccctagaacgcgtaggagggtctgggtgacgccgccgcaacggtaccgaaccgggtccgttagtactttacgtggtcgacgagacgtcggccgacaaacgacggacgttaacgggcgacctaaacttccgtaatcggttcttttaggaatttacgtcggtacgggggacctaaaggggtacctaaggtttcgg

SEQ ID NO: 307097 - DNA, 558 bp, Homo sapiens
  misc_feature: GZ8MTXP02IL6WP.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccagggaaggactggagcatagttggtatgtctttcacagtgggagactgactacaaacgcctccctcacggagtcgggtcaccatatcagtagacacgtaccaaagacgacctagttcctccctagaaacgctaggaggctgtgagcgccgcagacacggccgtgtacttactgtgcgtagacgtcggaccgacaaacgagacgtacggtggacctaaacgttcctagtcgtcgttttagaacgttactacgtacgggggaccaaacgggactaacgtacggg

SEQ ID NO: 307098 - DNA, 581 bp, Homo sapiens
  misc_feature: GZ8MTXP02IZYZ9.3.20.B09.1.454.CMB.2.raw
  modified_base (359)..(359): a, c, t, g, unknown or other
  misc_feature (359)..(359): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccagggaaggactggagcatagttggtatgtctttcacagtgggagactgactacaacgcctcctcaggacgtcggtcaccatancagtagacacgtaccaagacgcctagttcctccctagaagctggagggctggtgaggccgaccgcgaagaccgacggccgttagtacttaccgtgtacgcgaagccgtagggcccgacgaaaacgacgtaaccgtaccggggtagaccctaaaacttcccgtagtcggttaccttttagaattacgtcggtacggggaccctaaaggggactaaagttccgg

SEQ ID NO: 307099 - DNA, 594 bp, Homo sapiens
  misc_feature: GZ8MTXP02IKLD0.3.20.B09.1.454.CMB.2.raw
  modified_base (360)..(360): a, c, t, g, unknown or other
  misc_feature (360)..(360): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccagggaaggactggagcatattgggtatgtctttcacagtgggagactgactacaacgcctccctcaggagtcggtcaccatatcagtagacacgtccaagcgcctagttctccctagaagctgagggctgtgagcgccgcacgacacggcctgtattacgngtcgacgagacgtggcccgacgaaacgagtacgtacggtcggacaacgtcctagtgtcttttgatagtcgtcggggaccaagggactaagtcggtcaccgtctcgttacacgtcctaccaccgtaacgggccctacgttcccggtcccttcccccgtcggtaccctaccccgtcccgtaaccgacgtacgaacctacccgtcggtacgggggaccaccgacggcccggtcccgg

SEQ ID NO: 307100 - DNA, 547 bp, Homo sapiens
  misc_feature: GZ8MTXP02GJG06.3.20.B09.1.454.CMB.2.raw
  modified_base (354)..(354): a, c, t, g, unknown or other
  misc_feature (354)..(354): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtcttactactggagctggctccggcacgccccagggaaggctggagcatattggatgtctttcacagtgggagactgactacaacgcctcctcaggagtcggtcaccatancagtagacacgtaccaagacgccagttctccctagaaagctgagggctgtagagcgccgcaagaccaacggccgtgtacttacgtggtacgcggacgactcggccgacaaacagaccgtaacgggtgaccaaacttccctaagttaccgttctttagaattacgtcggtacggggacgaaaggaactaagtcg

SEQ ID NO: 307101 - DNA, 582 bp, Homo sapiens
  misc_feature: GZ8MTXP02FNJB6.3.20.B09.1.454.CMB.2.raw
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttacactggagctggctccggcacgccccgagggaaggactggagcatagttggtatgtcttcacagtgggagactgactacaacgctccncaggacgtcggtacaccgatatcagtanacacgtaccaagacgcctacgttcctcccgtagaagcgtaggaggactggtgacgcgaccgcgaacgaccgacggtccgtagttacttacgtgtcgcgagacgtcggaccgacgaaacgacggtacgtacggtcggacctaaacttaccgttagttcgtacgttttagaagtttacgtacggttacgggggaccgtaaaaggggacctaaggttccgg

SEQ ID NO: 307102 - DNA, 599 bp, Homo sapiens
  misc_feature: GZ8MTXP02FYYI4.3.20.B09.1.454.CMB.2.raw
  modified_base (351)..(351): a, c, t, g, unknown or other
  misc_feature (351)..(351): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgcccccagggagggactggagcatattgggtatgtctttcacagtgggaggactgactacaacgcctccctcaggagtccgggtcaccatatcagtagacacgtcaagacgccagttctccctgaacgctgagggtctggtgacgcgccgcacgacncggctgtatactgtgcgagtactcggccacaaacgagacgtacggtacggactaactccttatcgtcttttgtaattagtacgtcggggacgtaacgggaacgtaacgtggtaccgtaccggtacttccgttacgacgtaccctaccgaccgaaacgggccctacgtccgttcccttccccgtcggtacccacccctccctaccgacgtacgcctacgtccgtacggggacaccggacgcggtcccgg

SEQ ID NO: 307103 - DNA, 543 bp, Homo sapiens
  misc_feature: GZ8MTXP02HA3PK.3.20.B09.1.454.CMB.2.raw
  modified_base (248)..(248): a, c, t, g, unknown or other
  misc_feature (248)..(248): n is a, c, g, or t
  modified_base (312)..(312): a, c, t, g, unknown or other
  misc_feature (312)..(312): n is a, c, g, or t
  modified_base (360)..(360): a, c, t, g, unknown or other
  misc_feature (360)..(360): n is a, c, g, or t
  modified_base (462)..(462): a, c, t, g, unknown or other
  misc_feature (462)..(462): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctcatccgtcttanactggagctggctccggcagcccccagggaacggactggagcatagttgggtatgtctttcacngtgggagactgactacaacgcctcctcacggagtcgggtcacgatacncagtagacacgtccaagacgccagttcctcctagaagcgtggagggctgtgagcgcgcagacgacggcgtagtactacgtgtcgacgtagacgtcggccganaaccgagtaccgtacggtggactaactcctagtacgtcttttagaagttactcggtacgggacaacgggactaacgttcgg

SEQ ID NO: 307104 - DNA, 666 bp, Homo sapiens
  misc_feature: GZ8MTXP02HPL5K.3.20.B09.1.454.CMB.2.raw
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccgagggaagggactggagcatagttgggtatgtctttcacgagtgggagactgaactacaacgcctccctgaggagtcggtacacagtatacagtagacacgtaccaagacgacctagttcctacccgtagaacgcgtaggaacgggtctggtgacgccgcgacgacgaccgacggtcgtagtattacgngtcgacgagacgtcgggaccacaaactacgacgttacggnggaaccaaccttccgttaattcggttacttttaggaattaacgtcggtacgggaaccgaaagggtaacaaggttcggtacctaccggttcttcgtacgacgtcccgtacgaaacccgtaaggccccctaagttcccggtacccttcccccgtacggaccccttaccccctcgttaacccgaacggaccgaacccgtacccggtcgggtacgggggaccacggaccggcccggccccgg

SEQ ID NO: 307105 - DNA, 596 bp, Homo sapiens
  misc_feature: GZ8MTXP02HA6KJ.3.20.B09.1.454.CMB.2.raw
  modified_base (293)..(293): a, c, t, g, unknown or other
  misc_feature (293)..(293): n is a, c, g, or t
  modified_base (380)..(380): a, c, t, g, unknown or other
  misc_feature (380)..(380): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagacccctgtcccctcacctgcactgtctctggtgctccatcccgtccttactactggagctggctccggcacgcccccgagggaaggctggngcatagttgggtatgtctttcacgtaggtgggaggactagactaacgaaccgccctacctccgaggtacgtcgggtacaccgatacncgagtacgacacgtcaagacgcctaacgttcctcccgtagaacgctggacggctggtacgcgacgccgacgagaccgacggcgtgttacgttacgtgcggacgagtaccgtcggaccgacgaaacgacgaccgtacgggcggaccaacgttcgtaacgtcgttacgtttaacggagttacgttcgggtacggggacccgtaaaggggtactaacgg

SEQ ID NO: 307106 - DNA, 526 bp, Homo sapiens
  misc_feature: GZ8MTXP02IAYPA.3.20.B09.1.454.CMB.2.raw
  modified_base (264)..(264): a, c, t, g, unknown or other
  misc_feature (264)..(264): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggactggagcatattgggtatgtctttcacagtgggagactgactacaacgcctccctnaggagtcgggtcaccatatcagtagacacgtccaagagccagttcctccctagaagctgagggctgtgagcgccgnacgacgacggccgtgtattacgngtncgagacgtggccncaacagactacggngcaactcctatgtctttgatatcgtgggaccaagggacaagtgtacacgtctctcacgcctccacgacggccacgtcgtcctcccgcgccaccctccacaacgcgtcacgtcgtcggggcacgcgccgtccgg

SEQ ID NO: 307107 - DNA, 603 bp, Homo sapiens
  misc_feature: GZ8MTXP02GYX8R.3.20.B09.1.454.CMB.2.raw
  modified_base (293)..(293): a, c, t, g, unknown or other
  misc_feature (293)..(293): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
tcagagacgcactccacgaccggtgctcgatttagtgtagtgtgaagggggcaggagtcagtctcagtcaggacacagcatggacatgagggtcccccgctcagctcctggggctcctgctactctggctccgaggtgccagatgtgacatccagatgacccagtctccatcctccctgtctgcatctgtaggagacagagtcaccatcacttggccgggacaagtcagagctaattagcgttacttaattttaaagttggtatcaagaccaaacgaaaccgaagggaaaccncccctaaagcctcctgatctatgctagaactcctacttgacgtaaaggtcggtaccccatacgtaaggttcaggtgacnggtgatcgtagggactagtactttacaacttacctaaactntacgacgtccggttactacgacctaaccgtagtaacttacgtttacgacctaaactctaactactacgtaacaacgtagacgtagacacgaccaccgtacctactaccgtacggttaccggggacggaacgggtaccgaagggtacgaagaaacgtacgaaaaccggtagtggacggtactacggaaccc

SEQ ID NO: 307108 - DNA, 552 bp, Homo sapiens
  misc_feature: GZ8MTXP02G8OIV.3.20.B09.1.454.CMB.2.raw
  modified_base (370)..(370): a, c, t, g, unknown or other
  misc_feature (370)..(370): n is a, c, g, or t
  modified_base (459)..(459): a, c, t, g, unknown or other
  misc_feature (459)..(459): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttactactggagctggctccggcacgcccccgagggaacggactggagcatagttggtatgtctttcacgagtgggagactgactacaacgcctcctcgacggtacgtccggtcacatatacagtanacacgtacaagacgcctagttcctccgtagaagtcgtaggaggtctaggtgacgcgccgcgaacgcgacgggtccgttgtacgttacgngtcgcgaagcgtcggccgacgaacgacggtacgtacggtgaccgtaaactcgtactgtactttgaatacgtcgtcgggacaaggacaagtcgg

SEQ ID NO: 307109 - DNA, 596 bp, Homo sapiens
  misc_feature: GZ8MTXP02JASG2.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgccccgagggaacggactggagcatagttggtatgtcttcacgaggtgggagactgaactacgaaccgcctcctcgacggacgtccgggtcaacctatactcgagtacgactaccgtaccaaagacgcctaagttccctacccgtagaacgcgtaggagggtctggtggacgccggaccgacgacggtaaccgcggtaccgttagttacttacgtgtcgacgacgtacgtcggccgacaaacgacggtaccgtacggtcggacctaacttcgtagttcgtctttagaacttacggtcggtacgggaccgtaagggactaacgttcgg

SEQ ID NO: 307110 - DNA, 627 bp, Homo sapiens
  misc_feature: GZ8MTXP02H5RVM.3.20.B09.1.454.CMB.2.raw
  modified_base (202)..(202): a, c, t, g, unknown or other
  misc_feature (202)..(202): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgganaccctgtcccctcacctgcactgtctcgtggtgctccatccgtccttactactggagctggctccggcacgcccccgaggggaacggactggagcatagtgggtattgtcttcagtggtggagacgtgactaacaaaccgtcctacccgtgaacggagtccgggtacaaccatactacagtacgaacaccgtaccaaagacggacctacgttaccctcccgtaagaacgtccgtagggacgggtcgttaggaggacgccggaccgacgaacgaccgaccgggtccgttagttacgttacgtcgtagaccggtagacgtcggacccgacaaacgacggaccgtaacgggtcggaactaaccgtctagtcgttacgttttagaacgttatccggtacggggaacctaaaggggactaaaggttccgg

SEQ ID NO: 307111 - DNA, 587 bp, Homo sapiens
  misc_feature: GZ8MTXP02G8O6B.3.20.B09.1.454.CMB.2.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccggganaagtcagagcattagcgttacttaatttaaattggtatcagacaacaaaccgagggaaacncccctaagcctacctagactctatgctagaactcctactttgactaaaggtcgggtacccccagtcgaaggttcaggtggcnggtgatcgtagggactagtatttacactactaaaccatcgaggtccgtactacgacctaacctaggtaaagttactttacgacctaacgtctaactactacgtaacaacgagtagtnaacgtanacgtacgcctacgacctacggttccgggacgggaacggaccgaagggtacggaagtaacgtaacgaaaaccgtagtacggtacggtacctacgaaccc

SEQ ID NO: 307112 - DNA, 616 bp, Homo sapiens
  misc_feature: GZ8MTXP02GE24L.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctccagatgggtcctgtcccaggtgcagctgcaagagtcgggcccaggactggtgaagccttcggacgaccctgtccctcacctgcactgtctctggtgctccatcccgtccttactacgtggagctggcctccggcacgcccccgaaggggaacggacgtggagcattagtttgggtattgttctttcacgtaggtgggagactgaactacaacgcctcctacgacggacgtccgggtacaaccatatcagtacgaacacgtaccaagacgcctagttcctaccctagaacgctaggacgggctggtagacggccggcccgacgaacggaccgaccgggcccgttagttacttacgtggtcgacggagtaccgtcggcccgaacaaacgacggtaaccgtacggggtacgacctaaaccttcctagttcgttacttttagaacttacgtacggtacggggaccaaaggggactaagtccgg

SEQ ID NO: 307113 - DNA, 623 bp, Homo sapiens
  misc_feature: GZ8MTXP02IYHZT.3.20.B09.1.454.CMB.2.raw
  modified_base (255)..(255): a, c, t, g, unknown or other
  misc_feature (255)..(255): n is a, c, g, or t
  modified_base (490)..(490): a, c, t, g, unknown or other
  misc_feature (490)..(490): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtctactactggancgtgctccggcacgccccgagggacggactggagcatagttggtatgtcttcactagtgggagtactgactacaacgcctcctcgacggacgtcggtacaccgtatactcagtacgaactacgtaccaaggacacctaaggttccctacccgtagaaacgtcgttacggagggtctaggtagaacgccggccgacgtaacggacccgtaacgggtcccgttaggttaattaccgnggttacgccggtaagacggtaggcccgacgaaacacggtaaccgtaccgggtggacctaaaacgttcctaagtacggtccttttaggaattacgtcgttacgggggacctaaaagggacgtaacgtttccggg

SEQ ID NO: 307114 - DNA, 579 bp, Homo sapiens
  misc_feature: GZ8MTXP02H4LMV.3.20.B09.1.454.CMB.2.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccatccctccctgtctgcatctgtagganacagagtcaccatcacttggccggacaagtcagagcattagcgttactatttaaagtgtatcancaacaaaccgaggaacnccctaagctcngatnatgctnatcattgcaaagtcggtcccatcagtcngtggcnggtgatcgtgggactagtattcacttacaacatcagtcgtctcgactaactagtatatttacgactaaactctaactactagtactaaacgagaacttacggaacacgacgtaccgtacccacgtaacccgttaccgggtttcggaaccggggaacgggaacccggtaaaaggggttacggaaacgttaacgtaaacccggaaaaaaccggtacgttacggtacggtaccgtttaacggaaccccg

SEQ ID NO: 307115 - DNA, 594 bp, Homo sapiens
  misc_feature: GZ8MTXP02FSA2T.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccagggaaggactggagcatagttgggtatgtctttcacagtgggagactgactacaacgcctccctcacggacgtcgggtacaccgatatcagtacgacacgtaccaaagacgaccagtttcctccctaggaaacgtcgtaggaaggggtcctgggttacgacggccggaccgcgaacggaccgacgggtcccggtagttaacgtttacgtgtcgcgaagtacgtcggccgacaacgagaccgtaacgggtgaccaaaccgttcctaattcgtcttttaggaattacgtcggtaggggacctaacggggactaagttcgg

SEQ ID NO: 307116 - DNA, 660 bp, Homo sapiens
  misc_feature: GZ8MTXP02HALWA.3.20.B09.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (358)..(358): a, c, t, g, unknown or other
  misc_feature (358)..(358): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttanactgagctggctccggcacgccccagggaaggctggancatagtggtatgtctttcacgagtggagactgactacaacgcctcctacacggtacgtcggtcacctagttanacgagtacgacaccgtacaacgaagtcctacgttacctacccgttaggaaaacgtccgttaggaacccgggggttcgtacggtacggacgggtacccggacccggaacgaaaccggtacccggtaaccgggttaccggtttaacggttaacgtttacggtacggtacggtacggtaacggtacgtaccggaccgtaacgaaacgtaacggtaacggtacgggtacgacctaaccgttacttacgttcgtttacgtttagtaacgtacgtacggtacggaacggtaacggtaacgtacgtacg

SEQ ID NO: 307117 - DNA, 634 bp, Homo sapiens
  misc_feature: GZ8MTXP02JLUKL.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttacactggagctggctccggcacgcccccagggaaggactggagcatagttgggtatgtctttcacgagtgggagactgactacaacgcctcctcacggacgtcgggtcaccgatatcagtacgacaccggtaccaaagacgcctagttcctacccgtagtaacgccgtaggaacgggtctggtcggacggcgccggacaacggaccgaaaccgggtccggttagttaactttaccgtggtcgacggtaagaccgtcgggcccgacaaaacgaggtaaccgtacgggtacggacctaaaccgtaccgttagtacgttaccgtttttaggaagttacgttacggtacgggggtaaccgtaaacgggggtaacctaacggtttaccggg

SEQ ID NO: 307118 - DNA, 577 bp, Homo sapiens
  misc_feature: GZ8MTXP02G4U9I.3.20.B09.1.454.CMB.2.raw
  modified_base (339)..(339): a, c, t, g, unknown or other
  misc_feature (339)..(339): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcacgccccagggaaggactggagcatagttggtatgtcttcacaggtggagactgactacaacgcctcctnacggagtcggtcaccatatcagtacgacacgtccaaagacgaccagttcctccctagaacgctagagggctggtgacggcgccgcgaacgacgacggccgtgtacttacgtgtcgacgagtaccgtcgggacccgacgaaacgacgtaccgtacgggtcggaaccaaacgttcctaagtcgtacctttttagaagttaacgtcggtacgggggaccaaaggggtacctaaaggttcgg

SEQ ID NO: 307119 - DNA, 650 bp, Homo sapiens
  misc_feature: GZ8MTXP02HR0XI.3.20.B09.1.454.CMB.2.raw
  modified_base (486)..(486): a, c, t, g, unknown or other
  misc_feature (486)..(486): n is a, c, g, or t
  modified_base (535)..(535): a, c, t, g, unknown or other
  misc_feature (535)..(535): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctcggctccggcacggcccccgaggggaacggctaggacgcagttagtttgggtattggttcctttacgacgtaggtaggggacggacttaggactaacgaaccgtcccctacccgtacgacgggacggtccgggtaccaaccgtatactcgacgttaacgaacctaaccgtacccaaaggtacgaccgtacgttccctacccgtaggaacgcgtggacgggtcttggnggacggccgcccgagaaccggtacgcggtaccgtttagttactttacgnggtcgacggtagcgtcgggccaacgaacgacggacgtacgggtgacctaaacgttcctaagtcgttactttagcgttacgtcggtacggggaacctaaagggactaacggttcgg

SEQ ID NO: 307120 - DNA, 642 bp, Homo sapiens
  misc_feature: GZ8MTXP02GVI26.3.20.B09.1.454.CMB.2.raw
  modified_base (346)..(346): a, c, t, g, unknown or other
  misc_feature (346)..(346): n is a, c, g, or t
  modified_base (447)..(447): a, c, t, g, unknown or other
  misc_feature (447)..(447): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaacggactggagcatagttgggtatgtctttcacagtgggagactgactacaacgtcctacccgtnacggtacgtcggtcaccgatactcagtacgacacgtaccaagacgcctaagttcctccctaggaaacgtccgttaggacgggtctcggtgacggccgccgngaacgaccgacggccgttagtactttacgtgcgtacggagaccgtcggcccgacgaaacgaacggtaccgtaaacggggttcgaacccgtaaaccgttacccgttaagttccggttaccgtttttacggaagtttaacgttccggggttacgggggaaacccgtaaagggggtaaccctaaaaggtttcccgggg

SEQ ID NO: 307121 - DNA, 580 bp, Homo sapiens
  misc_feature: GZ8MTXP02JSNI7.3.20.B09.1.454.CMB.2.raw
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgcccccgagggaacggctggagcatagttgggtatgtctttcaacgngtgggagactgactacaacgcctcctnacggngtcggtcaccntancagtagacacgtaccaagcgccagttccncccgtagaacgctggagggctacggtgacgccgccgacgaaggtacccgacgggcccgttagtagtttaccgttggngacgaggacgtgggacccganaaacaggtaccgtacgggtggaccaaacttcctagtacgttctttagaatacgttcggtacggggtaccaaggggtaccaaaggttccgg

SEQ ID NO: 307122 - DNA, 566 bp, Homo sapiens
  misc_feature: GZ8MTXP02GN8PB.3.20.B09.1.454.CMB.2.raw
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
  modified_base (448)..(448): a, c, t, g, unknown or other
  misc_feature (448)..(448): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactggagctggctccggcagcccccagggaacggactggagcatattgggtatgtctttcacagtgggagactgactacaacgcctcccctnacggagtccggggtcaccgtatatcagtacgacacgtccaaagacgccagttcnccctagaacgctgagggctggtgacgcgccgcagacgacggccgtagtattacngtcgacgagactggccgacaaacgacgacgttaacgggcggacctaaactcccgtaagtcggtacctttttggaattacgtacggttcgggggacctaaaggggacctaagtttacgg

SEQ ID NO: 307123 - DNA, 595 bp, Homo sapiens
  misc_feature: GZ8MTXP02HQZUG.3.20.B09.1.454.CMB.2.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (427)..(427): a, c, t, g, unknown or other
  misc_feature (427)..(427): n is a, c, g, or t
tcagagacgcactccacgaccggtgctcgatttagtgtagtgtgaagggggcaggagtcagtctcagtcaggacacagcatggacatgagggtccccgctcagctccgtggggctcctgctactctggctccgaggtgccagatgtgacatccagatcgacccagtcctccatccctccctgtctgcatctggtagganacagagtcaccatcacgttggccggganaagtcagacgctattacgcgttactaatttaaagttggtatcagacaacaaacgaggaacncctaagctctgatctatcgtactagtaactcctagtttagacgtaaagggtccggggtacccctagtacgtaaggttcgaggtcggctaggtggtatcgtagggactagtacttaccactactaacatacgacgtcgtntacgtactaaccgtgtaagttacgtttacactaactactaacttactacgtacaagagtagtacgacacgcctaccgcctacgaccgttacggttacgggacgggtacggaaccgtaggtacggagtaacgtaaacgaaacgtacgtggtacggtacgtacgtaaccg

SEQ ID NO: 307124 - DNA, 608 bp, Homo sapiens
  misc_feature: GZ8MTXP02GZ92T.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttactactggagctggctccggcacgcccccgagggacggactggagcagtagttggtattgtctttcacgtagtgggagactgactacgaacgtcctcctcgacggacgtcggtcacgatactacgagtacgacacgtaccaagacgacctacgttcctcccgtaggaacgcgtaggagggtctggtcgacggccgaccgacgacggaccgaccgggtaccgttgttaacttacgtaggtcgacggtacgacgtcggacccgacgaaacgacgtacggtacggtggacctaacgttacctagttcgtacttttagaacgttacgtacggttacggggaccgtaaacgggactaacgttaccggg

SEQ ID NO: 307125 - DNA, 582 bp, Homo sapiens
  misc_feature: GZ8MTXP02G3MEM.3.20.B09.1.454.CMB.2.raw
  modified_base (370)..(370): a, c, t, g, unknown or other
  misc_feature (370)..(370): n is a, c, g, or t
  modified_base (466)..(466): a, c, t, g, unknown or other
  misc_feature (466)..(466): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagacccctgtcccctcacctgcactgtctctggtgctccatccgtccttactactggagctggctccggcacgcccccgagggaacggacgtggagcagtagttgggtatgtctttcacgaggtggagactagactaacgaccgcctccgtcgaggcgtcggtcacatancagtacgacgacgtaccaagacgacctagtcctcccgtagacgcgtgacggtcgtgtgcgaccgcgacacggacgaccggtccgtagtacttacgngtcgacgtacgcgtcggaccgacgaacgaacgacgtacgggtacgacctaaccgttctacgtcgttacgtttgaacgttacgtacgggtacgggaaccgtaacggggactaacggg

SEQ ID NO: 307126 - DNA, 497 bp, Homo sapiens
  misc_feature: GZ8MTXP02FMPTF.3.20.B09.1.454.CMB.2.raw
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagctctatttaaatggtatcagcacaaaccagggaaagcccctaagctcctgatctatgctgaatccactttgacaaaggtggggtcccccatcaaggttcagtggcngtggatcgtgggacagtatttcactctaaccatcagcgtcngacaactgaagtatttagcaactcactactgtacaacagagtgacagcacgcctacactacgttacggcggacgggaccgaaggtggagaagtacaaacgacgtgtcggctcgacc

SEQ ID NO: 307127 - DNA, 622 bp, Homo sapiens
  misc_feature: GZ8MTXP02IQSDL.3.20.B09.1.454.CMB.2.raw
  modified_base (280)..(280): a, c, t, g, unknown or other
  misc_feature (280)..(280): n is a, c, g, or t
  modified_base (430)..(430): a, c, t, g, unknown or other
  misc_feature (430)..(430): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtccaccatcacttggccgggacaagtcagagcattagcgttctaatttaaattggtatcagacacaaaccagggaaacncccctaagcctcctgactctatgcttgctatcctacttttgactaaacgttcggggtaccccatccgaggttcagcggcgaggggatcgtagggacctaggtactttcaactctacacccatcagcacgcctgcacgccgtagaaagttnttttacggacttaaacctttagttaacttcgtaacctaaacgtacggtaaccttaaccgttaacgttttaccctttaaaacgtttccgttaccgggtaaaccgtaacggggtaaaccaaccgggttaccgtaggggtaactaaacgttaaaacggaaacgttggtacgggtacttacggcctaaaccgtttc

SEQ ID NO: 307128 - DNA, 537 bp, Homo sapiens
  misc_feature: GZ8MTXP02HELEE.3.20.B09.1.454.CMB.2.raw
  modified_base (435)..(435): a, c, t, g, unknown or other
  misc_feature (435)..(435): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtgctccatccgtccttactactggagctggctccggcagcccccagggaaggactggagcatattgggtatgtctttcacagtggagactgactacaacgcctcctcaggacgtcggtacaccgatatcgagtagacacgtcaagagccagttctccctgaagctgaggctgtgagcgcgacgagacacggcgtgtacttacgngtgcgtagcgtggccacaacgacgacgtacgggtcggactaaacctccgtagtcgttacgtttaagagttaacgtcgtagggacccgaagggtaactaacgg

SEQ ID NO: 307129 - DNA, 646 bp, Homo sapiens
  misc_feature: GZ8MTXP02GI9PO.3.20.B09.1.454.CMB.2.raw
  modified_base (298)..(298): a, c, t, g, unknown or other
  misc_feature (298)..(298): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtccaccatctacgttcggccgggacaagtcaagagactaagttagcgttattaaattttaaattggtactcgagacaaacaaaccgagggaaaccncccctaagcctctagactctatgctagaactccgtactttgacgtaaaggttcggtacccccagtacgtaacggttcaggtgactagggtggaacttcggtaggggactagttactttaccacctactaaaccctatacgacggaccgttaccgtcgtaccgtaaacccgtaggttaaagtttagttttaccgaaccttaaaccttacctaacttaccgtacgtaccaaacgaggtacgtacgacacgcaaccgtcctacgtaccgttacggttcgggaacggacgggtaccgaaggggtacgaagtaacgaaccgaaaacgtacgtacggtacgtccgtagaacccc

SEQ ID NO: 307130 - DNA, 776 bp, Homo sapiens
  misc_feature: GZ8MTXP02F0032.3.20.B09.1.454.CMB.2.raw
  modified_base (273)..(273): a, c, t, g, unknown or other
  misc_feature (273)..(273): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcatagcgtctaatttaaatgtatcagcaacaaaccgagggaaacncccctaagctcctgatctatgctagaactccctacttttagacgtaaaacggttcggggtaccccccctaagttaccgtaaaagggtttcaaggttcgggacgtagggtgggtaaacttcggttacgggggaacctaaggttaacttttaccaaaccttaaccttaaaaccccattacccgaagggttcccgggttacctacggaaccctaaaacccgttagggtaaaagtttaactttttcggaaaccctaaaaccttaccctaaaccgtttaaacccgttaaggtttaacctaaaaacgtttaaggggaaagtttacggaaacccgtaacgggacccaaaccccggtaccccttacccgaaaccgtttaacccgggttttaccgggggaaccgggggtaaaccgggggtaaaccccgggaaaaggggtttacgggaaaacgtaacgttaaaccgtaaaaaccggtaaccggttagggtacggtaccgttacggtaaccccg

SEQ ID NO: 307131 - DNA, 587 bp, Homo sapiens
  misc_feature: GZ8MTXP02FKUJN.3.20.B09.1.454.CMB.2.raw
  modified_base (476)..(476): a, c, t, g, unknown or other
  misc_feature (476)..(476): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatcccgtcttactactggagctggctccggcacgccccgagggaaggactggagcagtagttgggtatgtctttcgacgaggtgggagactgactacaaccgcctccctcgacggtacgtccggtcaccatactcagtacgacacgtaccaagacgacctacgttcctcccgtagaacgtcgtaggaggggtctggtagacggccgaccgcgagaccgacgggccgttagtacttacgngtcgcgagacgtcggccgacgaacgacgaccgtacgggtgacctaacgttccgtaagtcgttacttttagaattacgtcggtacggggacctaaaggggacaacggttcgg

SEQ ID NO: 307132 - DNA, 560 bp, Homo sapiens
  misc_feature: GZ8MTXP02GVGE8.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactggagctggctccggcacgccccgagggaggactggagcatagttggtatgtctttcacgtaggtgggagactgactacaacgcctcctgacggacgtcggtcaccatatcagtagacacgtaccaagacgcctagtctccctagaacgcctaggaggtctggtagacggcgaccgcaggaccgaccgggcgtgtaacttacgtgtagcggaagctcggggccagaaccgagtaccggtacggtggacctacgtacctagttctctttagaacgtacgttccgaggggaccaaaggggactaaggttcgg

SEQ ID NO: 307133 - DNA, 642 bp, Homo sapiens
  misc_feature: GZ8MTXP02JOBK0.3.20.B09.1.454.CMB.2.raw
  modified_base (172)..(172): a, c, t, g, unknown or other
  misc_feature (172)..(172): n is a, c, g, or t
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
tcagagacgcactccacgaccggtgctcgatttagtgtagtgtgaagggacgagggtctccgaaggcttcaccagtcctggacctcctgtgcaagaacatgaaacatctgtggttcttccttctcctggtggcagctcccagatgggtcctgtcccaggtgcagctgcaagngtcgggcccaggactggtgaagccttcggganaccctgtccctcacctgcactgtctctggtgctccatccgtcttacactgganctggctcggcacgccccagggaacggctggacncgatacgttgggatggtcttnacgaggtcgggagactgactacgaacgtcctcctgacggtacgtcggtcaaccgatactcgagtacgacgacgtaccgaagacgactaacgtttccacccgttagaaacgtccgttaggaacggggtccttggtacgtaacggccgaccgacgtacgaccgaccggtacccggtacgttagttaaccgttacgttagcgacggaacgttacggccgacgaacgaacgaacgtacggttacggtaccggaaacgtaccgttaacctaggttaccgtttcggtaattaacgtccgttacgggtaccggtaacggtaacgaaacgtttaccggg

SEQ ID NO: 307134 - DNA, 653 bp, Homo sapiens
  misc_feature: GZ8MTXP02G67N5.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactacgtggagctggcctccggccacgcccccgaggggaacggacgtggagcagttagtttgggtattggttctttcgaacgtaggtgggaaggtactaggaactaccgaaaccgtccctacccgtcgacggtacgtccgggtacaacctagtacgtctaggtaacgacgaaccgtaccgaaagacgccctagtttcccacccgtagaacgtcgtaggacgggtctaggtcgacggccgaccgacgaacggtaccgaccggggtcgttagttacgttaccgtgtacggacgacggaccgtcggaccgtacgaaacgacgtacgtacgggtcgaacctaacgtcgtagttacgttctttagaacgttcgtacggacgggaaccgtaaacgggtactaacggttccgg

SEQ ID NO: 307135 - DNA, 568 bp, Homo sapiens
  misc_feature: GZ8MTXP02GQRPW.3.20.B09.1.454.CMB.2.raw
  modified_base (194)..(194): a, c, t, g, unknown or other
  misc_feature (194)..(194): n is a, c, g, or t
  modified_base (240)..(240): a, c, t, g, unknown or other
  misc_feature (240)..(240): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
  modified_base (451)..(451): a, c, t, g, unknown or other
  misc_feature (451)..(451): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggacaagtcagagcattagcgtntaatttaatgtatcagacaacaaacgaggaacaccctaagctctgatctatgactagaactcctactttgacgtaaaggtcggggtacccccatacgtaaggtcaggtggacnggtgatcgtaggganagtatttcactactaacatacagcgtctcgacaactagtaagtntttagactaactctactactacgactaaacgagtagtanaacgacgaccgaccgtccctacgtaaccgtcggttaccggggacgggtaaacggaccgtaaaggggtacggaagtaacgtaaacgaaaacgtacgtacggtacggtaccagtaaccc

SEQ ID NO: 307136 - DNA, 547 bp, Homo sapiens
  misc_feature: GZ8MTXP02GEZZ5.3.20.B09.1.454.CMB.2.raw
  modified_base (313)..(313): a, c, t, g, unknown or other
  misc_feature (313)..(313): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccattcccgtcttactactggagctggctccggcacgcccccgagggaacggactggagcatattggtatgtctttnacagtggagactgactacaacgcctcctcgagacgtcggtcaccatatcagtacactacgtaccaagtacgccagttccnccctagaacgctgaggctgtgacgcgaccgnacgacgacggaccgttntacgttactgtacgcgagtacgcggccgacaacgacgtaacgtacgggtcgacaacttactactcgtctttagaatagtcgtacgggactaacgggactaagtcgg

SEQ ID NO: 307137 - DNA, 543 bp, Homo sapiens
  misc_feature: GZ8MTXP02FHWY7.3.20.B09.1.454.CMB.2.raw
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcgtctaatttaaatggtatcagcaacaaaccgagggaaacncccctaagctcctgatctatgctagaactcctactttgactaaaggtcggggtacccccagtaccgaaggttcgaggtcggactaggtgggatcgtagggactagtactttcactactaaaccatacgagcgtcagacaactgaatatttagactaactcactactagtaacaacgagagtagacagactacgcctacactacgttcgggacggacgggaccgtaaggtggaagaagtacgaaaacgtacgtgtacggactacgaacc

SEQ ID NO: 307138 - DNA, 548 bp, Homo sapiens
  misc_feature: GZ8MTXP02FHD4N.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcacgcccccaggggaaggactggagcatattgggtatgtctttcacagtgggaggactgactacaacgcctccctcaggacgtcgggtcaccatatcagtagaacacgtaccaaagagccagttcctccctagaacgctggaggctgtgagcgacgcaggacacggccgtgtacttacgtgtcgcgacgacgtggcccgacaaacgacgacgtacgggtggacaaacctcctaatgtcttttagaattatcgtacgggggaccaaaggggacaaagtcgg

SEQ ID NO: 307139 - DNA, 609 bp, Homo sapiens
  misc_feature: GZ8MTXP02H2EE1.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactacgtggagctggctccggcacgcccccgagggtaacggactggagcatagttgggtatgtctttcacaggtgggagactgactacacgcctcctcacggacgtcggacaccatactcagtagacacgtaccaagcgacctagttcctaccgtagaacgcgtggaggtcttaggtgacgcgccgcaagacgaacggtcgtagttattacgtgtacgcgagtacgtggaccgacgaaaacgaggtaccgtaacgggttcggaacctaaaccgttaccgttaacgttcggtttacctttttaggaacgtttacgttaccggtacgggggtaacccaaaagggggtacctaaaacggtttccgg

SEQ ID NO: 307140 - DNA, 569 bp, Homo sapiens
  misc_feature: GZ8MTXP02HUPO1.3.20.B09.1.454.CMB.2.raw
  modified_base (268)..(268): a, c, t, g, unknown or other
  misc_feature (268)..(268): n is a, c, g, or t
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactgagctggctccggcngcccccagggaacggactggagcatatgggtatgtctttcacngtgggagactgactacaacgcctcctgacggagtcggtcacctatancngtanactacgtaccaagacgacctagtcctcccgtagaacgctaggaggtctagtgacgcgccgcgacgtacgacggccgtgtattacctggtgacggagtacgtcggaccgactaaacgacgtacgtacgggttcggacctaaactccgtaagtcgtcgttttagaattacgtacgttcggggacctaaaggggacctaaagttccgg

SEQ ID NO: 307141 - DNA, 687 bp, Homo sapiens
  misc_feature: GZ8MTXP02F2EBG.3.20.B09.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaacgccttcgganaccctgtccctcacctgcactgtctctggtgctccatcccgtcttactactggagctggctccggcacgccccgagggaacggctggacncatagttcgggtatgttctttcgactaggtgggaggtactgaacgtaaccaaccgccctcccgtacgacgggtacggttccgggtacaacccgtatacttacaggttacgaacgaaccggtaccaagacggaccctaacggtttcctacccgtagtaacgtccgtagggacgggtcgtggtacggacgtccggaccgacgacggaaccgaccgggtaccgttagttacgttacggtcgtcgacggtaacggtccgtacgggaccgacggaaactacgggaacgttacgggtacggaacctaaaacctccgttaaagttcggttcctttttaggaacgtttaaccggtcgggttaccggggaacccgtaaagggggtaacctaagggtttccggg

SEQ ID NO: 307142 - DNA, 572 bp, Homo sapiens
  misc_feature: GZ8MTXP02I80FG.3.20.B09.1.454.CMB.2.raw
  modified_base (343)..(343): a, c, t, g, unknown or other
  misc_feature (343)..(343): n is a, c, g, or t
  modified_base (423)..(423): a, c, t, g, unknown or other
  misc_feature (423)..(423): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaacggactggagcatagttggtatgtctttcacgagtgggagactgactacaacgcctacctnacggacgtcggtcaccatatcagtacgacacgtaccaagacgcctaagttcctccctagaacgcgtaggacgggcttggngacgccgaccgcgacgacgacggtccgtgtactacgtgtgcgacgacgtcggaccgacgaaacgacggtaacgtacgggtggaacctaaacgttcccgtaagtcgttctttagaattacgtcggtacggggacaacgggtacaagtcgg

SEQ ID NO: 307143 - DNA, 577 bp, Homo sapiens
  misc_feature: GZ8MTXP02HSX05.3.20.B09.1.454.CMB.2.raw
  modified_base (202)..(202): a, c, t, g, unknown or other
  misc_feature (202)..(202): n is a, c, g, or t
  modified_base (474)..(474): a, c, t, g, unknown or other
  misc_feature (474)..(474): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctgttggcagctcccagatgggtcctgtcccaggtgcagctgcaagagtcgggcccaggactggtgaagccttcgganacccctgtccctcacctgcactgtctctggtggctccatccgtccttactactggagctggctccggcacgcccccagggaaggactggagcatattgggtatgtctttcacagtgggagactgactacaacgcctccctcacggagtccgggtcacgatactcagtagacacgtaccaaagacgcctaggttcctccctagaacgctggagggtctaggtgagccgcgcagacgacggccgtgtattactgtacgcgagacgtcggaccgngaaacgacgacgttacgggcggaccaacgttcctagttcgtaccgtttttaggaacctttagtccggttacgggggaccgtaacggggactaacggttacggg

SEQ ID NO: 307144 - DNA, 655 bp, Homo sapiens
  misc_feature: GZ8MTXP02HATP0.3.20.B09.1.454.CMB.2.raw
  modified_base (502)..(502): a, c, t, g, unknown or other
  misc_feature (502)..(502): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtccttactactggagctggctccggcacgcccccgagggaacggactggagcatagttggtatgtctttcgacgaggtgggagtactgaacctacaaaccgtccctccgtcgacgggacgtccgggtacacctatacgtcgagtacgacaaccgtaccaagacgtcctaaggtttccctacccgtagaaacgtccgtaggaacgggtctggtagacggtccgacccgacgaacgacgaaccgggtccgttagtacttacgngtcggacgacgacgtcggcccgaacgaaacgtacgtaaccggtaccgggttacggacctaaaccgttaccgttagtccggttaccgttttagaacgtttacggtaccgggttacggggaacccgtaaaaggggtaactaaacggtttcccggg

SEQ ID NO: 307145 - DNA, 677 bp, Homo sapiens
  misc_feature: GZ8MTXP02GL6RV.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactggagctggctccggcacgccccgagggaaggactggagcatagttgggtatgtctttcacgtagtgggagactgactacaacgcctcctcgacggacgtccggtacaccatactcagtaacgacacgtaccaagacgcctaagttcctacccgtagaaacgcgtaggacggggtctggtacgacggccggacccgcgaaacggaaccgaccggggtccggttacggttatttaaccggtggttacggacggaacggtaccggttacggggaccccgaacgaaaaccgtaacggtaacccggttaaaccgggggtcggaacccgtaaaacccgttcccgttaaagttcggttacctttttaggaacgtttaacgttcggtacgggggtaaccccgtaaaagggggacctaaaacggtttcccggg

SEQ ID NO: 307146 - DNA, 548 bp, Homo sapiens
  misc_feature: GZ8MTXP02FIL4F.3.20.B09.1.454.CMB.2.raw
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtgctcatccgtccttactactggagctggctccggcacgccccgagggaggactggagcatatgggtatgtctttcacngtgggagacngactacaacgcctccncaggcgtcggtcaccatactcagtacgacacgtcaaagacgacctaagttcctacccgtagaacgtcgtgacggggctggtaggacgcgcccgacacgaccgacggccgtagtacttacgtgtcgacgagacgtggccgcgaaacgagacgtaggtcgactaacgtcctatcgtcgtttaagacttacgtcggtggacgaacggactaacgg

SEQ ID NO: 307147 - DNA, 529 bp, Homo sapiens
  misc_feature: GZ8MTXP02GNZIZ.3.20.B09.1.454.CMB.2.raw
  modified_base (436)..(436): a, c, t, g, unknown or other
  misc_feature (436)..(436): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtccttacactggagctggctccggcagcccccgagggacggactggagcatattgggtatgtctttcacagtgggagactgactacaacgcctccctcaggacgtcgggtcaccatactcagtagacacgtaccaagagccagttcctccctagaagctgagggctgtgagcgcgcagacacggcgtgtattacngtgcgagactcggccactaacgacgacgtacggtggaccaactcctagtcgtcttttagaattagtcgtcggggaccaaagggacaaagtcgg

SEQ ID NO: 307148 - DNA, 783 bp, Homo sapiens
  misc_feature: GZ8MTXP02HW48R.3.20.B09.1.454.CMB.2.raw
  modified_base (221)..(221): a, c, t, g, unknown or other
  misc_feature (221)..(221): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcacatcacttggccggganaagtcagagctattacgcgttacttaatttaaagttggtaactcgaagaccaaaccaaaaacccggaaggggaaaaccgtaccccctaaagccttaccgtagtaacttcctatcgtacctagtaaacttcctaacgtttcgaaaccgtaaagggttccggggtacccccaagttaccgtaagggttcagggtcggactaggggttcggtaacttcgtaggggtaactaacggttacttttacccaacccgtttaactaaaccctagttaccgaacggtcccggttacttaccgaaccgttaaacccgttaggtaaagtttaacgttttcggaaccttaaaaccgttccttaaaccttaccgttagtaaacccgaaaacgtaacggtaacgttaacgaaccgaaccggacctaacccggtacccctaacgttaacccgttaccgggtttaccggggaacccggggaaacggggtaacccggttaaaggggaacggtaaacggtaaaaccgttaaacccggaaaaacggtaaaccggttcggtaccgggacttaccggaacccg

SEQ ID NO: 307149 - DNA, 629 bp, Homo sapiens
  misc_feature: GZ8MTXP02HTY3T.3.20.B09.1.454.CMB.2.raw
  modified_base (260)..(260): a, c, t, g, unknown or other
  misc_feature (260)..(260): n is a, c, g, or t
  modified_base (372)..(372): a, c, t, g, unknown or other
  misc_feature (372)..(372): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctcgtccctcacctgccactgtctcgtggtgctccatcccgtccttactacgtgngctggctcggcacgccccgagggaacggactggagctagttagttggtatcgtctttcacgtggtgggagactagactaacacgccctcctcgacggacgtcgacacatacnagtacacacgtaccgaagcacgtacgttcctccgtagaacgtcgaggacggtcgtggtcggacgcgccgacgaacgaccggtacggtccgttagtacgttacgtcggtcgacggacgtaacgcggaccgaaccgaaacgaacggtaaccgtacgggtaccgaccgtaaccgtttactacgttacgttcgtttttagaacgtttacggttaccggttacgggggaaccggtaaaacgggtacgtaacggtttacccgg

SEQ ID NO: 307150 - DNA, 593 bp, Homo sapiens
  misc_feature: GZ8MTXP02FW3S5.3.20.B09.1.454.CMB.2.raw
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (387)..(387): a, c, t, g, unknown or other
  misc_feature (387)..(387): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccgttcggagaccctgtccctcacctgcactgtctctggtgctcatccgtcctatactgngcngctcgcacgccccgagggaggacgtggngacatagttggtatgtcttnacgaggtgggagactgactacacgtcctcctgacgagtcggacaccgatactacagtacacacgtaccaagacgccacttccncctagaacgtcgtggagggtctggtgacgccgccgacgacgaccgaacgggtccgttagttacttacggtagtcggacgacggtacgtcggaccgaacgaacacggaacggtacgggtcggaacccgtaactaccgttagtcgtttacgttttagaacgtttcgtacgggtacggggaccgtaaagggggtacctaacggttccgg

SEQ ID NO: 307151 - DNA, 628 bp, Homo sapiens
  misc_feature: GZ8MTXP02F2K0H.3.20.B09.1.454.CMB.2.raw
  modified_base (257)..(257): a, c, t, g, unknown or other
  misc_feature (257)..(257): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtccttacactgganctggctccggcacgccccagggacggctggagcatagttggtatgtctttcacgaggtggaggactgactacaacgcctccctcacggacgtcggtacaccatacncgagtanacacgtaccaagacgcctagttccctacccgtagaacgtcgtaggacggggcctggtacgacgccgccggacaaggtacccgacgggcccgttagtacgtttaccgtggtcgcggagtacgtcgggacccgacgaaacgaggaaccgttacggggtacggacctaaaccgtcccgttaagttcggttaccgtttttagaacgtttaacgtccgggttacgggggaacccaaagggggtaacctaaaggtttacccggg

SEQ ID NO: 307152 - DNA, 749 bp, Homo sapiens
  misc_feature: GZ8MTXP02J1THS.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggacaccctcgtccctcacctgcactgtctcgtggtgcctcctactcccgttccttactacgtggagcgtcggccgtccggcaccggcccccggaaggggaacggacgtggacgctagttaggtttggttattcgtttctttacgacgtagggtgggaacggtacgtacgaaccgtaaccgaaacccggtcccctaccccggtacgtaaccggggtaccggttccgggtaaccaacctagtacgttacgacggtaacgaaaccgaacccgtaacgaaacggtacgtaacccgttcgttacccttaccgaacggtaacgtcgttagggacggtcgttaggcgacggcccgacgacgaacggaccgaccgggtcgtagttacgttacgtggtacgacggtaacgtccggtcggacccgaacgaaaaccgtacggtaacccgtaacggggtacgaaacccgttaaccgttaccgttaagttccgtttacgtttagaacgtttacggtacggggttacggggaacccggtaaagggtaactaaacggtttcccgg

SEQ ID NO: 307153 - DNA, 630 bp, Homo sapiens
  misc_feature: GZ8MTXP02IIUY7.3.20.B09.1.454.CMB.2.raw
  modified_base (394)..(394): a, c, t, g, unknown or other
  misc_feature (394)..(394): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgttccttactactggagctggtcctccggcacggcccccgaaggggaacggactggacgctaagtacgtttgggtattcgtctttcgagtaggtgggagactgaactacaaccgtcctaccgtcgacggtacgtccggtacacctatactacngtacgacaccgtaccgaagtcgacctagttcctacccgtagaacgcgtaggacgggtctggtacgacggaccgccgacgaacgaccggtaccggtcgttagttaacttcggngtcgacgaacggtcgtcggacccganaaacgacggtacgtacgggtacgtaccttaacgttctagttcttacgtttagaacgttcgttacgggtacgggacgtaaacgggacttacggtaccgg

SEQ ID NO: 307154 - DNA, 574 bp, Homo sapiens
  misc_feature: GZ8MTXP02I1KMH.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcacgccccgagggaacggactggagcatagttggtatgtctttcacaggtggaggactgactacaacgtcctcctcgacggacgtcggtcactagtactacgagtacgactaccgtaccaaagacgaccagtttccacccgtagaacgtcgtaggagggtctggtacgaggccgccgcaaggaccacgggtccttagtacttacgtgtcgcgtaggacgtcgggccacgaaacgacgtaacgtacgggtgactaaactccgtaatcgttctttagaacgttagcgtacgggacaaggactagtacg

SEQ ID NO: 307155 - DNA, 586 bp, Homo sapiens
  misc_feature: GZ8MTXP02ICUEW.3.20.B09.1.454.CMB.2.raw
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctcatccgtccttactactggagctggctccggcacgcccccgagggaaggactggagcagtagttgggtatgtctttcacgnggtgggagactgactacaacgcctacccngacggacgtcgggtacacgatancagtacgacaccgtacaagacgactacgttccctacccgtagtaacgcgtaggacggggtcttcggagacggcgcccgacgacgaccgcgggaccgttagtaacttcgtgtcgacgagtccgcggccgacaacgacgacgtacggtcggactaaccgtccttactggtttctttaggaacttacgtcggtacggggacacggggaactaagtcccgg

SEQ ID NO: 307156 - DNA, 707 bp, Homo sapiens
  misc_feature: GZ8MTXP02F8WVE.3.20.B09.1.454.CMB.2.raw
  modified_base (294)..(294): a, c, t, g, unknown or other
  misc_feature (294)..(294): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactacgtggagctggcctccggcacgccccgaggggaacggactggancagtagttgggtatgtctttcgacgtaggtgggaggtactcggaactacgaaaccgtcccctccgtacgacgggtacgtccgggtacaacctatacacgacggtacacgaccgtaccaaacggtacgcccgtaacgtttccctaccccgttagaaacgtaccgttaggaacgggggtccttagggtcggaacggcccggacccgacgaacgggacccgtaaccggggtccgtttagttacgtttaacgttcgggacggtacggaacggtccgtacggggacccgaaccgtaaaaccgcggttaaaacccgtacgggggttaccgaacctaaaccgttacccttaacgttcggttaccttttaggaacttacggtcgggtacgggggaaccctaaaggggactaacggttccgg

SEQ ID NO: 307157 - DNA, 514 bp, Homo sapiens
  misc_feature: GZ8MTXP02FU16H.3.20.B09.1.454.CMB.2.raw
  modified_base (406)..(406): a, c, t, g, unknown or other
  misc_feature (406)..(406): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggcngtgagcgccgcagacacggccgtgtattactgtgcgagactggccgcaacagactacggtggcaactcctatcgtcttttgaatatcgtggggccaagggacagtcgg

SEQ ID NO: 307158 - DNA, 599 bp, Homo sapiens
  misc_feature: GZ8MTXP02FPKIU.3.20.B09.1.454.CMB.2.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagacgtcaccatcacttggccgggacaagtcaagagcattagcgtctatttaaatgtatcagcaagaaaccgaggaaacncccctaagcctcctgatctatgctgcatcctagtttgacgtaaaggtccggggtaccctagtacgaacggttcaaggttcggctaggtggtatcgtgggacagtatttcactctcacatcaacngtctagacaactgaagttatttacgactaacttactacgtntaacaactacgtactttaccacccttacccccttacgtacccgttaccggtttacccgggggaccgggggtaaaccctaaggggttacggaacgtaacgtaaccgaaaacgtaaccgttagggtcgtaccggttcgaaccgtaaccctttcgttaccg

SEQ ID NO: 307159 - DNA, 584 bp, Homo sapiens
  misc_feature: GZ8MTXP02JGLN0.3.20.B09.1.454.CMB.2.raw
  modified_base (377)..(377): a, c, t, g, unknown or other
  misc_feature (377)..(377): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactggagctggctccggcacgcccccgagggaacgggactggagcagtagttgggtatggttctttcacgaggtggggaggtactggactacaaccgcctcctcgacggagtccggtacaccatactcngtagacacgtaccaagacgcctagttcctccctagaagcgtgagggtctgtgacgcgaccgcacggaccgacgggtcccgttagtacgttacgtgtcggacgacgacgtcggccgacaacgaggtacgtacgggtcggaacctaacgttcctagttcgtacttttagaacttagtcgttacggggaccgtaagggacctagtaccgg

SEQ ID NO: 307160 - DNA, 524 bp, Homo sapiens
  misc_feature: GZ8MTXP02FJYP8.3.20.B09.1.454.CMB.2.raw
  modified_base (214)..(214): a, c, t, g, unknown or other
  misc_feature (214)..(214): n is a, c, g, or t
  modified_base (362)..(362): a, c, t, g, unknown or other
  misc_feature (362)..(362): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctnacctgcactgtctctggtgctccatccgtccttacactggagctggctccggcagcccccagggaggactggagcatattgggtatgtctttcacagtgggaggactgactacaacgcctccctcacggagtcgggtcaccgatatcngtagacacgtccaagagccagttctccctgaagctgagggctgtgagcgccgcagacacggcgtgtattactgtgcgagacgtggccgacaacgacgacgtacggtggacaaacgtcctagtcgtcttttgaatagtcgtggggacctaagggacaagtcgg

SEQ ID NO: 307161 - DNA, 565 bp, Homo sapiens
  misc_feature: GZ8MTXP02IUXOT.3.20.B09.1.454.CMB.2.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
  modified_base (374)..(375): a, c, t, g, unknown or other
  misc_feature (374)..(375): n is a, c, g, or t
  modified_base (382)..(382): a, c, t, g, unknown or other
  misc_feature (382)..(382): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccactcctccctgtctgcatctgtaggagacagagtccaccatcacttgccggcaagtcagagcattagcgttctaatttaaattggtatcagcaacaaacaggaaacncccctaagctcnatctatgctgaactccactttgacaaagtcgggtaccccagtcaagttcagtcggcnggtgatcgtggacagtattcactcaaacnncagcgtncgacactagatatttgactaacttacaacttatacgtacaaacgagtagtacgaacgagcctaccgccctacgacgtttaaccgtttcggggaccggggtaaacgggtaccggaaaagggttcggaaaacgtaacgttaaacccgaaaacggtaaaccgttggtacggtaacgttcgaacccg

SEQ ID NO: 307162 - DNA, 575 bp, Homo sapiens
  misc_feature: GZ8MTXP02HTGS4.3.20.B09.1.454.CMB.2.raw
  modified_base (255)..(255): a, c, t, g, unknown or other
  misc_feature (255)..(255): n is a, c, g, or t
  modified_base (435)..(435): a, c, t, g, unknown or other
  misc_feature (435)..(435): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactgganctggctccggcacgccccgagggaacggcgtggacgcagttagttgggtattgtctttacacgtaggtgggacgactcgaactaccaacgtcccctccgtcgacggcgtaccgggtcaaccatactacgagtacgaacaccgtacgaaagcgaccagttccctacccgtagaacgttcgnggtaggacttggcgaggccgccgacgacgaccgtacggcgtgtaattcgngtcgngagtcgacggcacaaagcgactcggtagactaactctatcgtactttagaatacgttcggacgggaccgtaaggctaacgttcgg

SEQ ID NO: 307163 - DNA, 538 bp, Homo sapiens
  misc_feature: GZ8MTXP02IFDOM.3.20.B09.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
  modified_base (450)..(450): a, c, t, g, unknown or other
  misc_feature (450)..(450): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttgccggnaagtcagagctatagcgtntattaattgtatcagcaacaaaccgaggaaacgcccctaaagctctagactctatgctagaacttcactttagactaaaggttcgggcccccagtacgtaaaggttcaaggtggctaggtggtatcggtagactagtatttcacttcaactatcagcgtntcgacaactgtactatttnactaactctactactagtaccaagagatgaacngacacgcctacacgtacgttacggaacgggacggaaccgaaggtagaagtaacgtaaacgaaacggtacgtaggtcgacgtacgaccg

SEQ ID NO: 307164 - DNA, 590 bp, Homo sapiens
  misc_feature: GZ8MTXP02HM6V4.3.20.B09.1.454.CMB.2.raw
  modified_base (254)..(254): a, c, t, g, unknown or other
  misc_feature (254)..(254): n is a, c, g, or t
  modified_base (412)..(412): a, c, t, g, unknown or other
  misc_feature (412)..(412): n is a, c, g, or t
  modified_base (456)..(456): a, c, t, g, unknown or other
  misc_feature (456)..(456): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggccccaggactggtgaagccttcggagacctgtccctcacctgcactgtctctggtggctccatccgtcctactatgngctggctccggcacgccccgagggaggactggagcaatagttgggtatgtctttacacgtaggtggggagtactcgaacgtaaccaacgtccctccccgtgaaccgggtacgtcgggtccaactagtattcgagttaacgacaacgtcccaaaggganccgtacgtctcccgtagaatcgaggtgggctgtgacgcgaccgnacgacgcggtccgttagtaattccgagtcgcgaggacgtcggccgacgaaacgacgtaacggtaacgtcgggactaaaccttcgttatacgtcttttaggaactagtcggtacgggactaacggactaagtccg

SEQ ID NO: 307165 - DNA, 573 bp, Homo sapiens
  misc_feature: GZ8MTXP02ICFDD.3.20.B09.1.454.CMB.2.raw
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (393)..(393): a, c, t, g, unknown or other
  misc_feature (393)..(393): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcttgcccaggactggtgaagccttcggagacccctgtccctcacctgcactgtctctggtgctccatccgtctactactgganctggctccggcacgcccccgagggaacggctggancatagttgggtatgtctttcagnggtggagctagactacacgcctcctcgagacgtcggtacacatatcgagtacgacaccgtccaagacgcctacgttccncccgtagaacgtctagggaggcttggtgacgccgcgcgacgtacgaccggccgttgtattaccgtgtacggacgtagcgtcggaccgacaacgacgaacggtcggtacgacctaaacgttccctaagttcgttccttttaagactacgttcggaccgggacgtaaacggggactaaacgg

SEQ ID NO: 307166 - DNA, 608 bp, Homo sapiens
  misc_feature: GZ8MTXP02G5ZID.3.20.B09.1.454.CMB.2.raw
  modified_base (213)..(213): a, c, t, g, unknown or other
  misc_feature (213)..(213): n is a, c, g, or t
  modified_base (488)..(488): a, c, t, g, unknown or other
  misc_feature (488)..(488): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccncacctgcactgtctctggtgctcatccgtccttacactgagctggctccggcacgcccccgagggaacggacgtaggacgcaagtagtttgggtattcgtctttcgacgtaggtagggaggtactacgaacgtacaacgtccctccgtacgacggtacgtcgggtacactatactcagtacgacacgtacgaacgacgacctacgttctccctaggaacgtcgtaggaggtctggtagacgccgaccgacgacgacgacggcgtagtacttacgngtagcgaagtcgtacggccgacaacgacgtaacgttacggacggtacaacgttacctacgttcgttactttagaacgttacgtcggttacggggactaaacggggtactaacggttccgg

SEQ ID NO: 307167 - DNA, 606 bp, Homo sapiens
  misc_feature: GZ8MTXP02H3Z5V.3.20.B09.1.454.CMB.2.raw
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtcttactactggagctggctccggcacgccccgagggaacggctggagcatagttgggtatgtctttcacgtaggtgggagtactgactacaaccgcctccctcgacggacgtcggtacaacctatacncagtagacaccgtacaagacgcctagttcctacccnggaacgcgttaggacgggtctaggtgaacggccgaccgcgaggacccgacgggtccgttaggtaacttcgttgcgacggtacgacgtcgggacccgacaacgacgtaacgtacgggtcggacctaaaccgtcgtaagtcggttcttttagaacgttagtaccggtacgggggaccctaaaggggtactaacggttcgg

SEQ ID NO: 307168 - DNA, 639 bp, Homo sapiens
  misc_feature: GZ8MTXP02GKFUV.3.20.B09.1.454.CMB.2.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctccagatgggtcctgtccaggtgcagctgcaagagtcgggccaggactggtgaagccttcggagaccctgtccctcacctgcactgtctctggtgctcatccgtcttactactggagctggctccggcacgccccgaggggaacggactggagcaattagttggtatggttctttcacgaggtgggagacgtgactaacgaaccgcctcctgacggacgtccgggtacaccatactcgagtanacacgtaccaagacnctaagttcctaccgtagaaacgtcgtaggaacggtcgtggtacggacgccggaccgacgaacggaaccgaccgggtacccgtttagtaacgtttaacgtcggttacgcggacggtaccgtcgggacccgacgaaaacgacggtaaccgtacgggttacggacctaaaacgttccgttaacgtcgttaccgtttgtaaaacgttcggttcggtacgggggaacaaacggggtaaccaagtttcccgg

SEQ ID NO: 307169 - DNA, 584 bp, Homo sapiens
  misc_feature: GZ8MTXP02GM9RT.3.20.B09.1.454.CMB.2.raw
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccttgtcccctcacctgccactgtctcgtggtgctccatcccgtcttactactggagctggctccggcacgccccgagggacggactggagcatagtggtatgttcttcacgagtgggagacgtgacgtacaaaccgcctccctacgacggtacgtccgggtacaccagtanacagtacgacacgtaccaagacgacctagttcctcctagaagctgaggctgtgagcgacgacgagacncggcgtagtattacgtgtcgacgagacgtcgaccgacgaacaggtacgtacgggtagacctaaaccgtccgttaagtcgttacttttagaacgtttacgtacggttacggggaccaaaacggggtactaaaacggttcgg

SEQ ID NO: 307170 - DNA, 559 bp, Homo sapiens
  misc_feature: GZ8MTXP02FUPXM.3.20.B09.1.454.CMB.2.raw
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccgttcggagaccctgtccctcacctgcactgtctctggtgctccatccgtcttactactggagctggctccggcacgccccgaggggaggctggancatagtggtatgtctttcgacagtcgggagacngactacacgtcctacctcaggacgtcggtcaacctatatacagtacgacacgtaccaagacgctagttccncctgaancgtgacggctgtagcgcgacgcaagtacgacggccgttgtaacttacgtgtaggcgaacgcgtcggccacaaacgtagacggtacggtggaccaaacttctagtcgttacgtttgaacgtagttcggacggggaccgtaaaagggactacgttaacgg

SEQ ID NO: 307171 - DNA, 613 bp, Homo sapiens
  misc_feature: GZ8MTXP02F7CJ2.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagacccctgtcccctcacctgcactgtctctggtggctccattcccgtccttactactggagctggctccggcacgcccccgaggggaaggctggagcagtagttgggtattgttctttcacgtaggtggggagtactggaactaacgaaccgcctcccctagacgggtagtcgggacaccatactcgagtacacacgtaccaagacgcctagttcctcccgtagaagcgttaggagggtctggtacgacgccggaccgcgaacgaccgtacgggccgtagttacttacgtgtcggacgtagacgtcggacccgacgaaacgacgtaacggtacgggtcgaacctaacgtccttagtacgttctttaggaacttaacgtcggtacggggaccaaaggggtaacctaggtccgg

SEQ ID NO: 307172 - DNA, 547 bp, Homo sapiens
  misc_feature: GZ8MTXP02H4I3H.3.20.B09.1.454.CMB.2.raw
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtccttatactgagctggctccggcacgccccgagggaggactggancatattgggtatgtctttcacgngtgggagactgactacaacgcctcctgacggagtcggcaccgatancagtagacacgtacaagcgccagttccncctgaacgcgtgaggctggtgagcgcgcacgacgacggcgtgtattacgtgtcgcgagacgtcggccgacaacgacgtacgtacgggtggaccaaaccttcctagttcgttcttttaggaattacgtacggttacggggaccgaaagggtcctaaagtccggg

SEQ ID NO: 307173 - DNA, 629 bp, Homo sapiens
  misc_feature: GZ8MTXP02G7FU9.3.20.B09.1.454.CMB.2.raw
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (385)..(385): a, c, t, g, unknown or other
  misc_feature (385)..(385): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccgagggaagggactggagcatagttgggtatgtctttcanaggtgggagactgactacaacgcctccctnaggngtcggtcaccgatatcagtanacacgtaccaagacncctagtttcctccctagaagtcgtcggagggtctggtgaacgcgccgacgaccgaccgtacggccgtagtattacgnggtgaccgagaccgtcgggaccacgaaacgtaacgaaccgttacggacggtacaaccgtctattcgtaccttttaggattacgtacgtacgggggaacctaaaggggaactaaacgtttcggaccgaacccgttctaccgttacaacgtccctaccgaccgaacggcccctagtcccggtccttccccgcgtacccacccttccaaccgaagtccaacaccgtcggcggacacgcgtccggccg

SEQ ID NO: 307174 - DNA, 622 bp, Homo sapiens
  misc_feature: GZ8MTXP02IR2NJ.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgccccgagggacggctggagcatagttggtatgtcttcgacggtgggagtactgactaacgaaccgcctccgtacgaggacgtcgggtaccaccaatactaccgtaagtacgaccaacgtaccaaagacgtacctaacgtttcctacccagaaacgtccgtaggacggtcttggcgagcccgccgacgacgaacccggccggtaccggttagtttaacgttaccgtggttacggacgtaacgacgtcgggacccgacaaacgagaacgttacgggcgacctaaacgttcctaaaggtcttacgttttagaacttaacgtcggtacgggaccaaggtacctaggtacggtaccc

SEQ ID NO: 307175 - DNA, 613 bp, Homo sapiens
  misc_feature: GZ8MTXP02I9M2Y.3.20.B09.1.454.CMB.2.raw
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
tcagagacgcactccacgaccggtgctcgatttagtgtagtgtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggaggtccctaagactctcctgtgcagcctctggactcaccttcacgctcaatcggccactacgtggactggggtcccnccgaggcctccgaggggaacgggctgggagtggggtgccgtttcagagacacaactaacagtcgacaccgcaacaataccggccgcgtctaggtagaaagcaagacttccaaccatcacaaagngatgattcgaagacgaactctaactttanctagacaaaatcgaaacagcctaggaacgaaacccgacgaaccgaccgggccttacttaagtttacttcggtacgttaccaagttaaccggaaccttaaggaacttaaaccgaaacggggtacggttacggttacccttaggggttaacttccgggg

SEQ ID NO: 307176 - DNA, 601 bp, Homo sapiens
  misc_feature: GZ8MTXP02G0CG8.3.20.B09.1.454.CMB.2.raw
  modified_base (289)..(289): a, c, t, g, unknown or other
  misc_feature (289)..(289): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtccctcacctgcactgtctctggtggctccatccgtccttactactggagctggctccggcacgccccgagggaagggactggagcatagttgggtatgtctttcacgaggtgggagactgactacaaccgcctcccncaggcgtcggtcacatatcagtagacacgtacaagacgacctaagttcctacccgtagaaacgtcgtaggacggggtctgtaggacgccggccgcgacgacgacgggccgttagtacttacgtgtgcgagacgtcggccgacgaacgacggtacgtacgggtcgacctaaccgtcctaagtcgtcttttagacttacgttcgacggggacgaagggacagtcgactaccgttctctcacgtccctacgaccgaccggccctacgtacccgtccgttaccccgtcgaccctacccgtcctaccgtacgacccg

SEQ ID NO: 307177 - DNA, 658 bp, Homo sapiens
  misc_feature: GZ8MTXP02G2780.3.20.B09.1.454.CMB.2.raw
  modified_base (291)..(291): a, c, t, g, unknown or other
  misc_feature (291)..(291): n is a, c, g, or t
  modified_base (533)..(533): a, c, t, g, unknown or other
  misc_feature (533)..(533): n is a, c, g, or t
  modified_base (585)..(585): a, c, t, g, unknown or other
  misc_feature (585)..(585): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtgctccatccgtccttactactggagctggctccggcacgccccgagggaacggactggagcatagttgggtatgtcttcacgaggtgggagactgactacaacgcctccctgaggacgtcggtcacatatcagtanaccacgtaccgaaagcgacctagttcctaccctgaaacgtcgtaggacggggtctgtgacgccgccgacaccggacgaccggtcgttagttaacgtttaccgtggtcggacgtaagccgtaccggggaccgaacaaacgacggtaccgtaacgggtacgactaaaccttcccgttaattcgttacttttagacgttacgtcggtacggggaaccgaaaggactaaggttcgtacacgttccncttacgcgccctacgaaccgacggccctacgttcccggtcccttccccggcnccctaacccctcccgtaccgaacggtacaacccgtaccggtcggtacggggaccaaccggtccggcgtcccgg

SEQ ID NO: 307178 - DNA, 731 bp, Homo sapiens
  misc_feature: GZ8MTXP02GITII.3.20.B09.1.454.CMB.2.raw
  modified_base (382)..(382): a, c, t, g, unknown or other
  misc_feature (382)..(382): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccgagggaggactggagcatagttgggtatgtctttcacgagtgggagactgactacacgcctccctcgaggtagtcggtcaccgatatcagtagacacgtaccaagcgcctagttcctaccctagaacgcgtggacgggtcgtgtgacgccgccgacacgaccgacggtccgtagtacttacgngtcggcgagacgtcggccgacgaaacgacgtaaccgtacggtacggaccgaacctccgtagtcgttaccgtttagacgttacgttacggtacggggtaccggtaaacgggtaacgtaacggttcggtaccgtacccggttccgttaccgttaccgtaccgtacccgttaccccgaacccggaaccgggtaccccgtaaccggttcccggttcccccgtttcccccgtcccgggtaccccttacccccgttaccccgttaacccgaaccggtacccgtaacccggttaccccggtccgggttaccggggggtaccctaaccgggtacccgggccccgggttcccccgggg

SEQ ID NO: 307179 - DNA, 623 bp, Homo sapiens
  misc_feature: GZ8MTXP02GJ50O.3.20.B09.1.454.CMB.2.raw
  modified_base (254)..(254): a, c, t, g, unknown or other
  misc_feature (254)..(254): n is a, c, g, or t
  modified_base (337)..(337): a, c, t, g, unknown or other
  misc_feature (337)..(337): n is a, c, g, or t
  modified_base (462)..(462): a, c, t, g, unknown or other
  misc_feature (462)..(462): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttatactgganctgctcggcacgccccgagggaggactggagcatagttgggtatgtctttcacaggtgggagactgaactacaacgcctcctnacggtacgtcgggtacacatactcagtacgacacgtaccaaagcgacctagttcctccgtagaacgcgtggaacggtctagtggaacggcgaccgcaggaacccgcggtaccgtgttacttaggngtcgacggtacgacgtcgggaacccgcgaaaacgaacggttaaccgacggggttacggacctaaaaccttccgttaaagtcggttacccttttttaggaacttttaacggcccggggttagggggaaccccgaaaaggggtaactaaaacgtttcccgggg

SEQ ID NO: 307180 - DNA, 563 bp, Homo sapiens
  misc_feature: GZ8MTXP02JJYFO.3.20.B09.1.454.CMB.2.raw
  modified_base (413)..(413): a, c, t, g, unknown or other
  misc_feature (413)..(413): n is a, c, g, or t
  modified_base (502)..(502): a, c, t, g, unknown or other
  misc_feature (502)..(502): n is a, c, g, or t
  modified_base (540)..(540): a, c, t, g, unknown or other
  misc_feature (540)..(540): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggacgaccctgtcccctcacctgcactgtctctggtgctccatccgtccttactactgagctggctccggcacgcccccagggaacggctggagccagtagtttgggatgttctttacacaggtgggagactgactacacgcctcctcacggagtcgggtcaccgatatcagtacgacgacgtaccaagacgtccaaggttcctcccgtacgaanccgtaggaggtctcggtagcggcgcccggcaacggaccgaacgggcccgttagtattacgtgtcgacgaggacgtcggaccgacaacgngaacgtacggtcggacaacgtctatcggtctttgaatntcgtcgggacacggactaagtcg

SEQ ID NO: 307181 - DNA, 564 bp, Homo sapiens
  misc_feature: GZ8MTXP02HNX1H.3.20.B09.1.454.CMB.2.raw
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (447)..(447): a, c, t, g, unknown or other
  misc_feature (447)..(447): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctccagatgggtcctgtcccaggtgcagctgcaagagtcggcccaggactggtgaagccttcggagaccctgtccctcacctgcactgtctcgtggtgctcatccgtcttanactggagctggctccggcacgcccccgagggaaggctggancatatgggatgtctttnacngtgggagactgactacaaacgcctacccncaggtaggtcggtacaccgattaanacagtacgacacgtacaagcgactacgtcctaccagaacgcgngaggngtgngacgcgcgacgacgacgacgcgtagtatacgtgngacgacgacgcggaccgacgaacgaacgtaacgtacggtacgactaacgtacgtacgtacgttacgtttacgtaacgttacgtacggtacgggaacggaaacggaacgtaacgtacg

SEQ ID NO: 307182 - DNA, 606 bp, Homo sapiens
  misc_feature: GZ8MTXP02FNFPM.3.20.B09.1.454.CMB.2.raw
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaaagcccgttcgganacccctgtcccctcacctgcactgtctctggtgctcatccgtcttacactggagctggctccggcacgccccaggggaaggactggancagtagttggattgttctttacacgaggtgggacggtactgactaaccgaaccgcctcccgtcgacggacgtcgggtacactatactcagtacactacgtacaagacgacctacgttcctacctaggaacgcgtacggaggtctggtgacgcggaccgcgaagaccgacggtccgtagttacttacgtgtacggcgaacgtcgtcggaccgacaaacgacgaacggtacggtagaaccgtaacttccgtaatcgttacgtttttagaaacgttgtaccggtacggggaacccgaaagggtactaggttaccgg

SEQ ID NO: 307183 - DNA, 588 bp, Homo sapiens
  misc_feature: GZ8MTXP02GF02A.3.20.B09.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (375)..(375): a, c, t, g, unknown or other
  misc_feature (375)..(375): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgganaccctgtccctcacctgcactgtctntggtgctcatccgtcttacacgtganctggctccggcacgcccccgaggggaacggactggagcatagttggtatgtctttacacgaggtgggaggactgactacaacgcctccctcacggtacgtcggtacacctactatcagtanacacgtaccaaagacgtaccgtacgttcctacccgtagtaacgcgttaggacggggtctggtaggacgccgccgacgacgaccgaacgggccgttagtacgttacgtgtcggacgacgtacggtcggacccgacgtaaacgacgacgtaacgggtcgacgtactacctagtcgtctttagaattcgacggtcggggacgaaggactagtacgg

SEQ ID NO: 307184 - DNA, 596 bp, Homo sapiens
  misc_feature: GZ8MTXP02GNWAF.3.20.B09.1.454.CMB.2.raw
  modified_base (313)..(313): a, c, t, g, unknown or other
  misc_feature (313)..(313): n is a, c, g, or t
  modified_base (428)..(428): a, c, t, g, unknown or other
  misc_feature (428)..(428): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctcgtggtgctcatccgtcttactatgagctgctccggcacgccccgagggaacggctggagcagtagttggtatgtactttcgacgnggtgggacgactagaacttacaaccgtcctacccgtgacggtacgtccgggtcaccattacgacgagtaacgactaccggtacaacgacgtccgtagttcctccgtagacgtcgnggaggtgtgcgacgcgaccgtacacggtacgcggttcgtagttacgtacgtgacgtacggacgtacgcggaccgacgtacgacgtacgtacggacgtacctacttacgttacgtcgttacgtttagtaacgtcggtacggtacggaacggaacggtacgttaaggtcg

SEQ ID NO: 307185 - DNA, 575 bp, Homo sapiens
  misc_feature: GZ8MTXP02IRFM8.3.20.B09.1.454.CMB.2.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
  modified_base (476)..(476): a, c, t, g, unknown or other
  misc_feature (476)..(476): n is a, c, g, or t
tcagagacgcactccacgaccggtgctcgatttagtgtagtgtgaagggacagggtctccgaaggcttcaccagtcctggacctcctgtgcaagaacacgaaaacatctgtggttcttccttctcctggtggcagctcccagatgggtcctgtcccaggtgcagctgcaagagtcgggcccaggactggtgaagcccttggagaccctgtcccctnacctgcactgtctctgtgctccatcccgtcttanactggagctggctccggcacgcccccgagggaacggactggancatagttgggtatgttctttcacgagtgggagactagactacaacgcctcctcgaggtacgtcgggtcacgatancagngacacgtacaaagcgacagttcctaccctgaacgtctggacggtntacgtgagccgccgacagtacaccggtccggtgtacttaccgtgtacgacgtaggtcgnggaccgacaacgagacgtacggtcgactacgtacctaagtcgttcttttagacttaacgtcggtacggggacaaacggggacctaagttcggtaacccg

SEQ ID NO: 307186 - DNA, 613 bp, Homo sapiens
  misc_feature: GZ8MTXP02JP5YS.3.20.B09.1.454.CMB.2.raw
  modified_base (260)..(260): a, c, t, g, unknown or other
  misc_feature (260)..(260): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagacccctgtcccctcacctgcactgtctctggtgctccatcccgtccttactactggancgtggcctccggcacgcccccgaggggaacggactggagcatagttgggtatgtctttcacgtaggtgggagactggactacgaaccgcctcctaccgaggtacgtcggtccacatactcagtagaccacgtaccaagacaccgtacgttcctccctagaacgtcgtggaggcgtgtgacgccgccgacgacggacacggtcgtagtacttacgtgtcgacgagtaccgtggaccgacgaaacgtacggtaacgtacgggttaccggacctaacccgttaccgttaagttcgttacgttttaacgtagttacgttacggtcggggtaaccgtaaaacggggtacttaaacggg

SEQ ID NO: 307187 - DNA, 644 bp, Homo sapiens
  misc_feature: GZ8MTXP02HD480.3.20.B09.1.454.CMB.2.raw
  modified_base (506)..(506): a, c, t, g, unknown or other
  misc_feature (506)..(506): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccattccgtccttactactggagctggctccggcacgcccccagggaacggctggagcagtagttggtattgtctttcacaggtgggaggactagactacaaccgtcctcctcgacggacgtcgggtaccaaccatactactaggtaacgaactaccgtaccaaagtacgcctaacggttcctccctagtaaacgcgtaggaagggcttgggcgaaggcccgaccgcgaagtaccgaacggtcccggttagtacgtttaccgttggacgnggtacggacgtacgggccgaaccgaaaacgtcgtaaaacggtcgggttaggaccctaacggtacccttaagtccggttacttttagaaaccgttgttacccgtgggggaacccaaaggggtcctaaaaggtttcccgg

SEQ ID NO: 307188 - DNA, 574 bp, Homo sapiens
  misc_feature: GZ8MTXP02JCABW.3.20.B09.1.454.CMB.2.raw
  modified_base (344)..(344): a, c, t, g, unknown or other
  misc_feature (344)..(344): n is a, c, g, or t
  modified_base (501)..(501): a, c, t, g, unknown or other
  misc_feature (501)..(501): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactactggagctggctccggcacgcccccgagggaaggactggagcatagttgggtattggtctttcacgaggtgggagactgactacgacgcctccncacggagtcggtcaccatatcagtagacacgtacaagacgccagttccaccctagaacgcgtggaacgggctggtgacgcgccgacgtaacgacgaccgggtccgttagtacttacggtgtcggacgaggacgtggaccgacaacgagacgtacggngaccaacttacctagttcgtcgtttttagaacgttacgtcggtacggggacccgaaagggactaacgttccgg

SEQ ID NO: 307189 - DNA, 839 bp, Homo sapiens
  misc_feature: GZ8MTXP02GCAQM.3.20.B09.1.454.CMB.2.raw
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtgctccatccgtccttactactggagctggctccggcacgcccccagggaagggactggagcatattgggtatgtctttcacaggtggagactgactacaacgcctccctcaggagtcggtcacatatcagtagactacgtaccaagacgccaactttcctcccgtagaaacgtccgtaggacggggtctgggttacgacggccgcccgacaaccgaccgtaccggtccgttagttacttaccgttggtcggccgtaagtaccgtcggggacccgacgaaaacggtacgtaacgtacggggtacggtaccctaaaccgttacccgttaagttcggttacccgtttttaaggaacgtttaacgtaccgggtttaacgggggtaaacccgaaaacgggggtaaaccgttaaacgggttacgggttacccgtaaacccgggtttcccttaaccgttttcccgaaccgttacccccgttacccgaaacccggttaaacccgggcccccgttaaccggttacccgggtttacccccgtttccccccggttacgggaccccccgttaaccccctttacccccgttaacccgaaaaccggttaccgaaccccgttaaaacccccggtttccggggtaaaccggggggtcccctaaaaccggtaaccccggggacccgggttaccccccgggg

SEQ ID NO: 307190 - DNA, 635 bp, Homo sapiens
  misc_feature: GZ8MTXP02I2EWE.3.20.B09.1.454.CMB.2.raw
  modified_base (275)..(275): a, c, t, g, unknown or other
  misc_feature (275)..(275): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatcacttgccggcaagtcagagcaattagcgttattaatttaatggtatcagacaacaaacgagggaaccnccctaagctctgatctatgctagaactcctactttgacgtaaacggttcgggaccccctataccgtaaaggtttcaaggttcggactagggttgggacttcggtacggggtaactaggttactttaccaaaccttaccttaaacccagttacgtacggttacggttctacggtaacctaaaccgttagtaaacgttacttttacgaacctaacttacctaacttacgtgtaaaccaacgtaggacgtacgacacggtaccaccgtacctaccgtacgtaccgggttcgggaaccgggacgggtaccgtaaagggtcggaacgaacgtaacgaaaacggacgttcgacggtacgtacgacc

SEQ ID NO: 307191 - DNA, 702 bp, Homo sapiens
  misc_feature: GZ8MTXP02IJFWS.3.20.B09.1.454.CMB.2.raw
  modified_base (273)..(273): a, c, t, g, unknown or other
  misc_feature (273)..(273): n is a, c, g, or t
  modified_base (378)..(378): a, c, t, g, unknown or other
  misc_feature (378)..(378): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatcccgtccttactactggagctggctccggcacgcccccaggggaacgggactgggagcatattgggtatgttctttcacagtgggaggactgactacaaccgcctccctnaggagtcggtcaccatatcagtagacacgtccaagcgccaagttcctccctagacgctggacgggtctgtggagccgccgcacgaccacggcctgtacttaccgngtcggcaaggccgtcggccgacaacgagtaccgtaggcgacaacgttcctagttcgtacgtttagaacttacgtcggtggggaaaccctaaagggggtaacctaacggttcgggtacctaaccccgggttcttaccgttaccgaaccgtccctaacccggacccggtaaacggggccccctaacgttccggggtttcccccttacccccggaggttaccccccaaccccgtttccccgaaaccccgaagtacccggtaacccttaccccgggttaccgggtaccgggggaccaaacccggcgggggtacccccggttcccgggg

SEQ ID NO: 307192 - DNA, 704 bp, Homo sapiens
  misc_feature: GZ8MTXP02JMJN4.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatcccgttccttactacgtggagctcggctccggcacgcccccgaggggaacggactggagctagtagtttgggtattcgttctttacgacgtaggttaggggacgtacgtgtaaccttaccgaaaccgtcccctacccgtacgacgggtacggtccgggtaccaacctatactacgagtacgacacgtaccgaagacgcctagttccctccgtagaacgtcgtaggacgggtctaggtcggacgccggaccgcgaacggaccgaccggtaccgttaggttacttaccggtaggtacgcggaacgtacggtcgggacccgaacgtaaacgacggtaaccggttaaccgggtcggtaaaccctaaccgttacccgttaaggtttcggtttacccttttaggtaacgttaacggtttccgggtaaccgggggtaccgtaaaacggggaccgttaacggtttacccggg

SEQ ID NO: 307193 - DNA, 599 bp, Homo sapiens
  misc_feature: GZ8MTXP02GF13K.3.20.B09.1.454.CMB.2.raw
  modified_base (308)..(308): a, c, t, g, unknown or other
  misc_feature (308)..(308): n is a, c, g, or t
  modified_base (474)..(474): a, c, t, g, unknown or other
  misc_feature (474)..(474): n is a, c, g, or t
  modified_base (556)..(556): a, c, t, g, unknown or other
  misc_feature (556)..(556): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttactactggagctggctccggcacgccccgagggaaggactggagcatagttgggtatgtcttnacgtgtggagactgactacaaccgcctacctcgacggtagtccgggacaaccatactacgagtacgacaccgtaccaagacgcctaagttcctacccgtgaaacgtctaggaaggtccgtggtacgacggccgccgacgaacgaccgacggcgttgtacttacggngtcgacgacgtcgtacggccgacaaacgtacgaacgtacgggtacgtactaaaccgttacctacgttacgttccgtttaagngttacgttcggtacgggaccgtaaaggaacgtaacgtttacgg

SEQ ID NO: 307194 - DNA, 575 bp, Homo sapiens
  misc_feature: GZ8MTXP02FMBOP.3.20.B09.1.454.CMB.2.raw
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctcgtggtgctccatccgtccttactactggagcgtggccgtccggcacgccccgaggggaacggactggagctagtagttggtatgtctttnactggtgggaggactggaactacaacgcctaccctgaggacgtcggtacacatancagtanaactacgtaccaagtacgcctagttcctccgtagaacgtcgtggaggtctggngacgccgccgagtacgaccgaacggtccgtagtacttacgtgtcgacgagtacgtcggcacaacgagtaacgtacgggtagaccaaactccttagtcgtacttttagaattcgtcggtacgggaccgtaaggactaaggtccg

SEQ ID NO: 307195 - DNA, 638 bp, Homo sapiens
  misc_feature: GZ8MTXP02JSJO5.3.20.B09.1.454.CMB.2.raw
  modified_base (589)..(589): a, c, t, g, unknown or other
  misc_feature (589)..(589): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgcccccagggaaggactggagcatagttgggtatgttctttcacaggtgggaggactgactaacgaacgccctccctcgaggacgtcggtcaccatatcagtagacacgtaccaagacgcctagtttccaccctaggaacgtcgtaggagggtctggtggacgccgccggcaacggaccgacgggtccgtagttactacgtgtgacggagtaccgtcggggacaccgtaaacgacggtaccgtaccgggtaggaccaaccttccgttaagtcgttcgttttacgaatcgttcgggtacggggaaccgaaaggggtaacaacgttcggtacctacccgttctaccgttcaacgtccctaccgaccgacggtccacgtccgtcctccccgtgacccnccctacaccaagccgctaccgtcggcggacaccggtacgcccgtccggg

SEQ ID NO: 307196 - DNA, 559 bp, Homo sapiens
  misc_feature: GZ8MTXP02FT1NT.3.20.B09.1.454.CMB.2.raw
  modified_base (257)..(257): a, c, t, g, unknown or other
  misc_feature (257)..(257): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactactgganctggctccggcacgcccccgagggaaggactggagcatattggtatgtcttcacagtgggagatgactacaacgcctcctcgacggagtcggtacaccgtataatcgagtagactacgtaccaaganccagttccncctgaanctgaggctgtgagcgcgcagacgacggcgtagtacttacgngtcgngagtacnggccgacaaacgtagactacggggagacaaaccttcctaagttcggtacctttttggaaacttagttcggtacgggggacccgaaaaggggacctaaaggttccgg

SEQ ID NO: 307197 - DNA, 609 bp, Homo sapiens
  misc_feature: GZ8MTXP02ISED9.3.20.B09.1.454.CMB.2.raw
  modified_base (392)..(392): a, c, t, g, unknown or other
  misc_feature (392)..(392): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgggagaccctgtccctcacctgcactgtctctggtgctccatcccgtcttactactggagctggctccggcacgccccgagggaggactggagcagtagttggtattgttctttcacgaggtgggagactgactacaacgtcctcctgacggtacgtcggtacacctatactcagtacgacacgtaccaagacncctacgttcctccgtagtaacgcgtggagggtctggtgacgccgaccgcgaacgacgacgggtccgttagttacgttcgtagtcgacggagacgtcggaccgacaaacgacggtaacgtacgggtcggaacctaaccttaccgtagttcgtaccgtttttaggaacttaacggttcggttacgggggaaccgtaaacggggtactaacgtttaccgg

SEQ ID NO: 307198 - DNA, 571 bp, Homo sapiens
  misc_feature: GZ8MTXP02FXEX8.3.20.B09.1.454.CMB.2.raw
  modified_base (381)..(381): a, c, t, g, unknown or other
  misc_feature (381)..(381): n is a, c, g, or t
  modified_base (478)..(478): a, c, t, g, unknown or other
  misc_feature (478)..(478): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttacactggagctggctccggcacgcccccgagggaaggactggagcagtattgggtatgtctttcacagtgggagactgactacaacgcctcctcgacgagtcggtcaccatatcagtacgacacggtaccaaganccagttcctccctagaacgctaggagggtctgtgacgccgccgcgaacgtaccgaacggccgtgtaacgtttacgtgtcgacgagtacgcggccganaaacgagtaacgtacgggtcggactaacctcctaagttcgtccttttagaagttcgtacggtcggggaaccgaaaggggaactaagtttccgg

SEQ ID NO: 307199 - DNA, 623 bp, Homo sapiens
  misc_feature: GZ8MTXP02G0JRE.3.20.B09.1.454.CMB.2.raw
  modified_base (171)..(171): a, c, t, g, unknown or other
  misc_feature (171)..(171): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagngtctggcccaggactggtgaagccttcggagacccctgtccctcacctgcactgtctcgnggtgctcatccgtctanctganctgctcgcncgcccgaggagctgagcatagtggtatgtcttcagtggtgggagacgtgtactaccgaacgccctccgccgacgggtacgtcgggtacaacacgttatccgtaagtaacgacctaaccgtaccgaaacgacgacccgtaacgttccctacccgtacgaagcccgtagggacgggtccgtgggtcgacggcgccgaccgaacgaccggaccgggtcgttcgtacgttaccgtggcgtaccgaggtcgccggaccgacgaaaccgacggtaaccgtaggtcggtactaaaccggttcctaagtcggtttacttgtacgttaacgttcggtaccgggggaactaaacggggtaacgttaacggg

SEQ ID NO: 307200 - DNA, 646 bp, Homo sapiens
  misc_feature: GZ8MTXP02J2L7A.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtccttactacgtggagctggctccggcacgcccccgagggaacggacgtggacgcagttagttcgggtattgttctttacacgtaggtgggacggtactagaacctacgaaccgtccctcccgtacgacgggtacgtccgggtacaccgtatactacgacgtacgaaccgtaccgtaccaaaggaccgtacctacggttaccctacccgtagaacgtcgtagggacggtcgtgtcgacgccgaccgacgacgaccgaccggtcgttagtagttaccgtggtcgacggtacgacgtccggaccgacaacgacgtaccgtacgggtaggacctaaacttccgtagtcgttacctttagaacttacggtacggtcggggtaaccgaacgggtaactaacggttccgg

SEQ ID NO: 307201 - DNA, 644 bp, Homo sapiens
  misc_feature: GZ8MTXP02JMAJN.3.20.B09.1.454.CMB.2.raw
  modified_base (170)..(170): a, c, t, g, unknown or other
  misc_feature (170)..(170): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtgcagctcccagatgggtcctgtcccaggtgcagctgcaagngtcgggccaggactggtgaagccttcggagaccctgtccctcacctgcactgtctcgtggngctcatccgtcttanacgtgagctggctccggcacgcccgagggacggctggancagtagtggtattgtcttcacgaggtgggaggactgactacgaaccgtcctacccgtacgacgggtacgtccggggtacaaccgtagtaacgtacgtaggttaaccgaaccgtaccggtaacccgaaaggaccgtacccgtaacgttcccgtacccgtaggaaaccgtcgtaggacggggtctacgggacgtacggccggccgacgaaacggacgaccgggtccgttagttaacttcggtacgtagacggtacgacgtcggacccgacaacgacgtacgtacgggcgtacgaaacttccgtagtcgttcttaggaacttacggttcggacggggtacaacggggtactacggttaccgg

SEQ ID NO: 307202 - DNA, 602 bp, Homo sapiens
  misc_feature: GZ8MTXP02IXZCP.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaacctgtccctcacctgcactgtctctggtgctcatccgtcttacactggagctggctccggcacgcccccagggaacggactggagcatagttgggtattgtctttcacgtagtgggaggactgactacaacgccctcctcgacggagtccggtacaccgtatactcagtacgacacgtaccaagcgcacgttcctcctagaagcgttggacgggtctaggtgacggccgccgcgacgaccgacgggcccgttagtacgttacgtgtcgcggacgacgtcggcccgacaaaacgacgtaaccggtacgggtcgggacctaaaccgttccgttaacgtcgttacgtttttcgaagttacgtcggttacgggggaccctaacgggggactaaaggttccgg

SEQ ID NO: 307203 - DNA, 639 bp, Homo sapiens
  misc_feature: GZ8MTXP02IMNHL.3.20.B09.1.454.CMB.2.raw
  modified_base (217)..(217): a, c, t, g, unknown or other
  misc_feature (217)..(217): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagacccctgtccctcacctgcactgtctctggtgctccatccgtccttactactggagctggctccggcacgcccccgagggaacggactggancaattagttgggtatggtctttcaactaggtggaaggactggactacaacgtcctccctcaggtagtcggtcacatatcagtagacacgtccaagcgcctagtctcctagaagctgagggcttgtagagcgccgcgaacgaccaccggtccgtagtactttacgtcgtgcgaagaccgtgggacccgacaaacgaggacttacggcgacgaactctagtgttcgtttagatactcgtagggtaccgaaaggtactaagttacggtacctaacggttcctcgtttaaccgacgtacccgtaccgaccgtacggtccctaacgttcccgttacccttccccgtacgtaccccgtaccctcccgtaccgtaacgaccgtaaccgtacccgtccggtacgggacctaccggtacggcccggtaccg

SEQ ID NO: 307204 - DNA, 657 bp, Homo sapiens
  misc_feature: GZ8MTXP02FPYB3.3.20.B09.1.454.CMB.2.raw
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaaggctggancatagttgggtatgtctttcacagtgggagactgactacacgcctccctnacggagtcggtcaccatancagtagacacgtaccaagagccagtttctccctgaacgctggaggctgtcgagcgccgcacgacgacggcgtgtattacgtgtgcgagactcggcccgacaaacgacgaaccgttacgggtacggacctaaaacttcccgttaaatttcggtaccgttttttacgaagtttaacgttccggtacgggggtaacccgtaaaacgggggaacttaaacggtcggttacccgtaaccccgttcgttacctttacgaccgtccctacccgaacccgaacggggtccccaacgttcccggtccctttcccccggaggtccctaccccgtcctaccgaacgacgtccctacgtcggcggggacaccggcggccggtcccgg

SEQ ID NO: 307205 - DNA, 789 bp, Homo sapiens
  misc_feature: GZ8MTXP02FJLFZ.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtagaacgtccgttcggacgtaccctcgtccctcacctgcctactgtctcgtggtcgctccatcccgtcttactcgtgagcgtggcctccggcaccgcccccgaggggaacggacgtggacgactaagtacgtttagggtatgttctttacaacgtaggtaggggaggtacgtagacctaaaccgaaaccgccctaccccgtcgaacgggacggttccggggtaccaaccgtaacttacgtacgtacggtacgaaaccgtaccggtaaccccaaaggaccggacctacgttttaccccgtacccgttaggaaacgtccggtagggtaacggggtccgttagggttcggaacggtcccgggaccccgacgtaaacgggacccgaaccgggtcccggttacgtttaacgtttaccggttaggtccggttacgggaacgtaaaccgttccgggcccgacaaaaacccgggtacgtaaaaccgggttaccgggttagggaaccctaaaccgttacccgttaagtttaccggtcttttttaaggaacgttaaacgtttcgggtaccgggggaaccgtaaaacggggtaacgtaacggtttaaccggg

SEQ ID NO: 307206 - DNA, 705 bp, Homo sapiens
  misc_feature: GZ8MTXP02IGF6O.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgggagacccctggttcccctcacctgcactgtctctggtgctccatccgtcttactactggagctggctccggcacgccccgagggaacggactggagcattagttgggtattgttctttcacaggtgggagactgaactacgaaaccgccctcctcgacggacggttccgggtaccaaccgtattaacgtcgtacggtaacgaaccgtaaccgttacccgaaaaggaccggtacctaacggtttaccctcccgttaacggaaacgtccgttaaggggaacggggtcccgtttagggtcggaacggccggcccgtacggaaccggtaccgaacccgggtcccgggtttagttaaacctttacggtacgttggaacccggagtacgtaccgggtaccgttaaacgacggacccgttaaagggttcggacctaaacttcgttaatcgttcgtttttagagttaacgtacggtcggggtaccaaaggttaccgaaagttcgggttacccg

SEQ ID NO: 307207 - DNA, 584 bp, Homo sapiens
  misc_feature: GZ8MTXP02I7YRN.3.20.B09.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (475)..(475): a, c, t, g, unknown or other
  misc_feature (475)..(475): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcgganaccctgtccctnacctgcactgtctntggtgctccatccgtccttacactggagctggctccggcacgcccccgagggacggacgtggagcatagttggggtatgtctttacacgtaggtggaggactgactacgaccgcctcctacgaggacgtcggcaccatactcgagtacgacacgtaccaagacgcctacgtcctccctagaaacgcgtaggaacgggtccgtgtaggacgccgccgacgacgaccgacggtccgtagtacgttacgngtcgacggagtacgtcggaccgacaaacgtacgaaccgttacgggacggacaaccgttcctaagttcgtactttaagactacgtcggtacgggacgaacggactaacgg

SEQ ID NO: 307208 - DNA, 662 bp, Homo sapiens
  misc_feature: GZ8MTXP02HILJ2.3.20.B09.1.454.CMB.2.raw
  modified_base (365)..(365): a, c, t, g, unknown or other
  misc_feature (365)..(365): n is a, c, g, or t
  modified_base (419)..(419): a, c, t, g, unknown or other
  misc_feature (419)..(419): n is a, c, g, or t
  modified_base (523)..(523): a, c, t, g, unknown or other
  misc_feature (523)..(523): n is a, c, g, or t
tcagagacgcactccacgaccggtgctcgatttagtgtagtgtgaagggacagggtctccgaaggcttcaccagtcctggacctcctgtgcaagaacatgaaaacatctgtggttcttccttctcctggtggcagctcccagatgggtcctgtcccaggtgcagctgcaagagtcgggcccaggactggtgaagccttcggagaccctcgtccctcacctgcactgtctcgtggtgctccatccgtccttactacgtggacgctggcctccggcaccggcccccgaaggggaacggactggagcaagtagttgggtattgtctttacacgaggtgggacgactgaactacaacgcctcctgacgngtcggtcaactatactcagtacgaacaccgtacgaaagacgaccgtagttcccncccgttaaaggaacgccggtgggtaaaccgggtcttagggtacgaacggtcccggaccgacgaaaccggttaccgggacccggtcggttagtaacgtttacggnggtacgacggacgtacgtcggaccgaacgaaacgtacgtaacggtacggtacgaaacctaccgttaccgttagtcgtttaacgtttacgaacgttacggtacgggtacggggaaaccgtaacggtaacttaacggtccg

SEQ ID NO: 307209 - DNA, 621 bp, Homo sapiens
  misc_feature: GZ8MTXP02G1BC5.3.20.B09.1.454.CMB.2.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggtagctcccagatgggtcctgtcccaggtgcagctgcaagagtcgggcccagggactgggtgaagccttcggagaccctgtcccctcacctgcactgtctctggtgctcatccgtccttanactggagcnggctccggcacgccccgagggaacggctggagcatagtgggtatgtctttcacgaggtgggagactgactacacgccctcctcgaggacgtccgggcacatactcgaagtacgacacgtaccgaaagacgaccgtacgttccctaccgtacgaaagtccgtagggaacgggtcgtaggtacggacgccggaccgacgaacggtaccgaccgggccgttgttaacgttactgggtagaccggagtaaccggcggaccggacaacggacgaacggttacgggacggtaccaacttcccgtattaccgttactttgtaactaacgtcggtaccgggaccgaaggaacctagtacggttaacccg

SEQ ID NO: 307210 - DNA, 600 bp, Homo sapiens
  misc_feature: GZ8MTXP02G9DEY.3.20.B09.1.454.CMB.2.raw
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (558)..(558): a, c, t, g, unknown or other
  misc_feature (558)..(558): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagccccagggaaggactggagcatattgggtatgtctttcacagtgggagactgactacaacgcctccctcaggacgtcgggtcaccagtactcagtagacacgtccaagacgccagttctcccgtagaacgctgagggctgtgagcgccgtnacgtacacggccgtagtacgttacngtcgcgagacgtggctgacaaacacgacgtaacggtgaccactcctatcgtctttgattagtcgtcgggaccaagggactaagtcggtcgaccgtctacgttcacgccctaccaaccgaaacggcccctaacgtcccggttccctcccccgtcggcccctaccccgttaccctaccaaaaccggtccnccgtaacccgttcggacgggggacccacggaacgccccgggg

SEQ ID NO: 307211 - DNA, 654 bp, Homo sapiens
  misc_feature: GZ8MTXP02GTJMD.3.20.B09.1.454.CMB.2.raw
  modified_base (171)..(171): a, c, t, g, unknown or other
  misc_feature (171)..(171): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagngtcgggcccaggactggtgaagccttcggacgaccctgtccctcacctgcactgtctgtggtgcctcatccgtcttacactggagctggctccggcacgccccgagggacggctggagcagtagttggtatgtcttcacgaggtgggagactgactacgaacgtcctaccgtgacggacgtcggtacaaccgtatacgtacgtaggtacgaaccgaccgtaccgaaacgtacggaccctaaacgggtttccctaccccggtaagaaacggtccgtagggacgggtacgtggtacggacggccgaccgacgaacgaccgaccggtcgtagttacgttacgtgtcgacggacgtacgtacggaccgacgaaacgacggtaacgtacgggttacggacccttaaaccggtccttagttacgtacgttttacgaagtttccgtacggttcgggggaaacccgtaaaggggaactaacggtttccggg

SEQ ID NO: 307212 - DNA, 608 bp, Homo sapiens
  misc_feature: GZ8MTXP02GPX7V.3.20.B09.1.454.CMB.2.raw
  modified_base (286)..(286): a, c, t, g, unknown or other
  misc_feature (286)..(286): n is a, c, g, or t
  modified_base (394)..(394): a, c, t, g, unknown or other
  misc_feature (394)..(394): n is a, c, g, or t
  modified_base (432)..(432): a, c, t, g, unknown or other
  misc_feature (432)..(432): n is a, c, g, or t
tcagagacgcactccacgaccggtgctcgatttagtgtagtgtgaagggggcaggagtcagtctcagtcaggacacagcatggacatgagggtcccccgctcagctcctggggctcctgctactctggctccgaggtgccagatgtgacatccagatgacccagtcctccatcctccctgtctgcatctggtaggagacagagtccaccatcacttggccgggacaagtcagagcattagcgtacttatttaaagttggtatcagcaacaaaccgaagggaaaccncccctaaagcctacgtgactctatcgctagaacttcctacgtttagacgtaaaggtcggggtacccccagtacgtaacggttcaggttcggcagggttcgagttacgnggggaactaggttaactttcaaaccttctaaaaccctntacgacgtcgtctacgctaaacgtagaaacgttatttcgaactaactctaacctagtacgtacaacgagtacgtgacacgacaccgtacctacacgttaccgttcggggaacggtacgggaacgtaacggtaggacgtaagtaaccgaaaacgtacgtagtacggtacgtacaccg

SEQ ID NO: 307213 - DNA, 694 bp, Homo sapiens
  misc_feature: GZ8MTXP02G0PJR.3.20.B09.1.454.CMB.2.raw
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtgctccatccgtccttactactggagctggctccggcacgcccccgagggaaggactggagcatagttgggtatcgttctttcacgaggtgggagactgactacacgcctcctgaggacgtcggtaccaccatactacgagtacgacacgtaccgaagacncctacgttcctccgtagaacgcgtaggacgggtctggtgacgccgacgacgaccgaccgccggtcgtacgttattacgngtcggacgagccgtcgccgacaacgtacgtacgtacggtcgacctaacgttccgtagttacggtctttaggattacgtacggtacggggaaactaacggggtaaactaacggttcggtaaccccgttacggttcttacccggttaccaccggtcccctaaccggaaccggaaacccgggtccctacggtttcccgtaccccgtttcccccgacggtccccttaaccccgttccgaaccgaaggtaccctcccggtaaccgttcggggacggggaccaaccggccgggtccccggtcccgg

SEQ ID NO: 307214 - DNA, 605 bp, Homo sapiens
  misc_feature: GZ8MTXP02IUJV3.3.20.B09.1.454.CMB.2.raw
  modified_base (288)..(288): a, c, t, g, unknown or other
  misc_feature (288)..(288): n is a, c, g, or t
  modified_base (367)..(367): a, c, t, g, unknown or other
  misc_feature (367)..(367): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccagggaaggactggagcatagttgggtatgtctttcacagtgggagactgactacacgcctccctcaggagtcggtcaccatatcagtanacacgtaccaagacgcctagttctccctagaagctggagggctgtgagcgccgcacgaccgacggccgtagtattacgngtcggcgagacgtcgggccacgaaacacgaccgtaacggtggaccaacgtcctatcgttcttttagacttagtcggtacgggtacgaaaggggtacaaagttcgggtacctacccggttctcgttaccgacgtccctaccaaccgaaccggtccacgttccggtcccttccccgtcgtcccaaccccttcaacccgtaagcgaacctaccgtcgtcggggacacgacgccggtcccgg

SEQ ID NO: 307215 - DNA, 626 bp, Homo sapiens
  misc_feature: GZ8MTXP02F6UVZ.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgtcttactacgtggagctggctccggcacgcccccgaggggaacggacgtggagcagtagtttggtatgttcttcacgtaggtggaggtactcgactaacgaacgtacctcccgtacgacggtacggtccggtacacctatactacgagtacaacgtaccgtaccaagacgcctacgttccctaccgtagaacgtcgtaggacgggtcgtaggtcgaacgccggaccgacgaacggaccggtaccggtccgttagttacgttaccgtgtcgacgagtacggtcggaccgacgaacgacggtacgtacgggtacggacctaacgttacctagtacgttctttaggaacttacgtcggtacggaccgtaacgggtactaaggtccgg

SEQ ID NO: 307216 - DNA, 578 bp, Homo sapiens
  misc_feature: GZ8MTXP02G31GV.3.20.B09.1.454.CMB.2.raw
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (403)..(403): a, c, t, g, unknown or other
  misc_feature (403)..(403): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaaggagtcgggcccaggactggtgaagccttcggagaccctgtccctcacctgcactgtctctggtgctcatccgtcttacatgganctggctccggcacgccccagggaggctggancatagtggtatgtcttcanagtgggagactgactacaacgcctccgtcacggagtcggtcacatactcagtacacacgtacaagacgcagttccncctagaacgcgtgagggcttagngacgcgccgacgtacgacgtacggaccgttgtacgttacgtgtcgacgtacgaacgtcggccgaacaacgtaacggtaactacggggttacgaccgtaaacctccgttaagttcgttcgttttaggaaacttcgttcgggtacggggaccaaaaggggtacctaagttacccggg

SEQ ID NO: 307217 - DNA, 654 bp, Homo sapiens
  misc_feature: GZ8MTXP02IS93L.3.20.B09.1.454.CMB.2.raw
  modified_base (294)..(294): a, c, t, g, unknown or other
  misc_feature (294)..(294): n is a, c, g, or t
  modified_base (369)..(369): a, c, t, g, unknown or other
  misc_feature (369)..(369): n is a, c, g, or t
  modified_base (403)..(403): a, c, t, g, unknown or other
  misc_feature (403)..(403): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctcgtggtcgctcactccgtcttatactggacgctggctccggcacggccccgagggaggactaggacncagtagttgggtattgttctttcacgtaggtgggagactgactaccacgtcctaccgtgacgtagtcggtcacgntactcagtacgcaacgtaccaagacgcagttccnctaggactgtggaggctaggtgaagtccgacgtcgacggaaccgaccgggtccgttagtacgtttaagtcggtaggacgttacggacgttacggggacccgaacgaaactacgggtaaaccgttacggggtaccgggtaacctaaaaccggttcccgttagttacggtttactttttaacgggaaactttacggtttacgggtaaccgggggtaccgtaaaaaccgggggtacttaaaacggtttaccggg

SEQ ID NO: 307218 - DNA, 602 bp, Homo sapiens
  misc_feature: GZ8MTXP02FPF3H.3.20.B09.1.454.CMB.2.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtgctccatccgtccttactactggagctggctccggcacgcccccgaggaaggactggagcatattgggtatgtctttcacagtggagctgactacacgcctccctcaggagtcgggtcaccatatcagtagacacgtcaagacgcagttctccctgaacgctgagggctggtgagcgcccgcacgaccacggccgtgtacttacnggtncgagactcggccncaaacagaactacggtcggacaactcctaatntcttttagattatcgtcggggaccgaacgggaacaatcggtacctaacccggtctaccttcacgtaccctcccaacccgaaaccgggcccaaacgtccggttcccttccccccgttcggtcccacccccttaccctacccgaaacgacggccaacccgtcgtacgggggccaaccgaacggtccggtccccgg

SEQ ID NO: 307219 - DNA, 574 bp, Homo sapiens
  misc_feature: GZ8MTXP02G3AFP.3.20.B09.1.454.CMB.2.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
  modified_base (421)..(421): a, c, t, g, unknown or other
  misc_feature (421)..(421): n is a, c, g, or t
  modified_base (533)..(533): a, c, t, g, unknown or other
  misc_feature (533)..(533): n is a, c, g, or t
  modified_base (563)..(563): a, c, t, g, unknown or other
  misc_feature (563)..(563): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgganaccctgtccctcacctgcactgtctctggtgctcatccgtcttactacgtgagctgctccggcacgccccgagggaggctggancagtagttggtatgttcttnacgaggtggagtactgaactacaaccgtcctcctgacggtacgtcggtacaccatatacagtacacaccgtacaagcnctagttccaccgtagaacgtcgtaggcggtacttggngacgccgaccgcgaacgtcgaccggtcgttaggtacttacgtgtacgacgaacgtcgcggccgtacaaagcgtacgtacggcgaccgaacttccgtaacgtgttcgttaagngtaacgttcggacggggaacaacggggtanaacgtttccgg

SEQ ID NO: 307220 - DNA, 766 bp, Homo sapiens
  misc_feature: GZ8MTXP02GOD73.3.20.B09.1.454.CMB.2.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcgganaccctgtcccncacctgcactgtctcgtggtcgctccattcccgtccttatacgtggagctggctccggcacgccccgagggacggactgganctatagttggtattcgtctttgacgtaggtgggagtactggaaccttaacaaccgtcccgtccctacgaaccggggtacggttccggggtaacctaacccgtagttaacgtacgtacgggtaacgtaaacccgtaacggttaacccgaaagggaccgtaccccgttaaccgggtttacccgtaccccgtaggtaaaccgtccggttaagggggaccgggtaccgttgggttaaacggccgggtaccgggacccgtacgaaccgggttaaccgaccggggttaccccggtttagttaacccgtttaggttggtcccggacggaacggtaccggtacggggcccaacgtaaaacgtaccggtacggttaaaacccggtcggaaaccctaaaccgttacgtaccttagtttcctttaaggtaacgttacggtccgggtacgggacccggtaaaggtaaccccgtagttacccgg

SEQ ID NO: 307221 - DNA, 555 bp, Homo sapiens
  misc_feature: GZ8MTXP02HTGA9.3.20.B09.1.454.CMB.2.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcgganacccctgtccctcacctgcactgtctctggtgctccatccgtcttactactggacgctggctccggcacgcccccgagggaacggactggagcatattggggattgtcttcanggtggagatgactaacaccgtcctccncgagacgtcggtcacgacttanccagtacgacacgtacaagcgccagtctacccngacgctagaggtctagtgacgcgccggacacgacgacggccgttagtacgttactgtcgcgaacgcgtcggccaacgtaaccgcggaaactacggtcgactaaacctccgtattacgcgtttttaagacgttacgtcggacggaccgtacggactacg

SEQ ID NO: 307222 - DNA, 544 bp, Homo sapiens
  misc_feature: GZ8MTXP02HE2Q2.3.20.B09.1.454.CMB.2.raw
  modified_base (287)..(287): a, c, t, g, unknown or other
  misc_feature (287)..(287): n is a, c, g, or t
  modified_base (336)..(336): a, c, t, g, unknown or other
  misc_feature (336)..(336): n is a, c, g, or t
  modified_base (380)..(380): a, c, t, g, unknown or other
  misc_feature (380)..(380): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (444)..(444): a, c, t, g, unknown or other
  misc_feature (444)..(444): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctccatccgttcttacactggagctggctccggcacgcccccgagggaaggacnggagcatagtggtatgtcttcacagtggagactgactaacaaacgtccncctcaggacgtcggtcaacatatcagtacacacgaccaaagacncacgttactcccagaaacgcgagacgggngngngagcgcgcgagacgacgcgtagtatacgtgngacgagacgacgacgacgaacgaacgacgtacgtacgactactactacgtcgttacttagtaagtacgtacggtacggacggaacggaacgtaacgtacg

SEQ ID NO: 307223 - DNA, 732 bp, Homo sapiens
  misc_feature: GZ8MTXP02IU82Y.3.20.B09.1.454.CMB.2.raw
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgcccccgagggaaggactggagcatagttgggtatgtctttcacaggtgggagactgactacaacgcctccctcaggagtcggtcacatatcagtagacacgtcaagacgccagttcctcctgaacgtcgtggagggtctggtgacgccgccgacacgaccgacgggccgttagtagttactggtggcgaagacgtcggacccgacaaacgtacgacgtacggtcggactaaccgtacttagtcgttcgttttagaagttacgtcgggtacggggaaaccgtaaacgggtaacgtaaacggttcggtaaccgtacccggttccgttacccgttacgaccggtacccctacccgaaacccggtaaccggtaccccgtaaccgttcccggttaccccgtttccccccggtaccgggtaccccctacccccgttaccccgttaaccccgaacggtaacccgtaaccccgtaaaccccggttccggggtacccggggggtacccaacccgggtaaccgggtcccccggggttacccccgggg

SEQ ID NO: 307224 - DNA, 623 bp, Homo sapiens
  misc_feature: GZ8MTXP02G1OLM.3.20.B09.1.454.CMB.2.raw
  modified_base (171)..(171): a, c, t, g, unknown or other
  misc_feature (171)..(171): n is a, c, g, or t
  modified_base (237)..(237): a, c, t, g, unknown or other
  misc_feature (237)..(237): n is a, c, g, or t
  modified_base (499)..(499): a, c, t, g, unknown or other
  misc_feature (499)..(499): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagngtcgggcccaggactggtgaagccttcggagaccctgtccctcacctgcactgtctctggtgctcntccgtcttactactggagctggctccggcacgccccgaggggaacggactggagcatagttggtatgttcttcacgaggtgggaggactgacttacgaaccgtcctccctacgaccggtacgtaccggtcaacctatactacgagtacgaacaccgtaccaaacgacgtccgtagttcccaccgttagaagcgtaggacggcgtggtagacgccgtccgacaaggtaccgaccgggtccgtagttacgttacgtagcgacgngtaccgtcggccgacgaaacgacgtaacctacgggtacggacctaaaccgtccttaagtcgttacttttagaagtttcgtaccgggttacgggaacccgtaaaggggtacctaaacggttccgg

SEQ ID NO: 307225 - DNA, 598 bp, Homo sapiens
  misc_feature: GZ8MTXP02IH8YT.3.20.B09.1.454.CMB.2.raw
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggacgtggtgaagccgttcggacgaccctgtccctcacctgcactgtctcgtggtgctccactccgttccttactacgtggacgtcgtcggctccggccgacggcccccgaagggaacggcgtaggacgcgtaattaggttggtatcgttctttcacgaggtgggagtacgtcgaactacgaaccgtcctcccgacgacgggtacgtccggtacactagtactacagtacgacaccgtaccaagacgcctacgtctcccagtaacgcgtaggacgggtctggtgacggccgccgacgacgacgaccggtcgttagtagttacgtgtcgacggacgacggtcggaccgacgaacgacgtacggtacgcgactactctatcgttnttacgntagtacggcggacgaacggcgtaagtcg

SEQ ID NO: 307226 - DNA, 660 bp, Homo sapiens
  misc_feature: GZ8MTXP02F8ELJ.3.20.B09.1.454.CMB.2.raw
  modified_base (286)..(286): a, c, t, g, unknown or other
  misc_feature (286)..(286): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcacgccccgagggaggctggagcatagttgggtatgttctttcacgagtgggagactgactacaacgcctccctcaggacgtcggtcaccatacncagtacgacacgtcaagcgccagttcctccgtgaagcgtggacggctaggtgagccgccgcgaacgtaccacggtcgttagtacttaccgtggtcgacggacgtcgtcgggacccagaaacgacggaacgtacgggtacggacctaacgttacctagttgtaccgttttagaacttacgtcggtacggggacgtaaacgggactaaggtcggtacctaccgttcctcgttacgaccgtaccctacccgaaccgaaccggtccctacggttccggttccccttcccccggtcgtaccccgtaccccctaccgtacccgaacgaccgtaacccgtaccgtccgggtacggggaccaccgacggtacccgtcccggg

SEQ ID NO: 307227 - DNA, 624 bp, Homo sapiens
  misc_feature: GZ8MTXP02G4X4H.3.20.B09.1.454.CMB.2.raw
  modified_base (179)..(179): a, c, t, g, unknown or other
  misc_feature (179)..(179): n is a, c, g, or t
  modified_base (213)..(213): a, c, t, g, unknown or other
  misc_feature (213)..(213): n is a, c, g, or t
  modified_base (282)..(282): a, c, t, g, unknown or other
  misc_feature (282)..(282): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (548)..(548): a, c, t, g, unknown or other
  misc_feature (548)..(548): n is a, c, g, or t
tcagagacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtgctccatccgtcttactactgganctggctccggcacgccccgagggaaggactggancagtagttgggtatgtctttcacgaggtgggagactgactacacgcctcctcgaggagtcggtcacatntcagtagacacgtacaagcgcctagttcctccgagaagcgtaggacgggtcgtgtcggagccgccggtacacggaccgacggtcttagtacttacgngtcgacgtacgacggtccgaccacgaacgacgtacgtcgganacctatcctagtnttcctttagattacgtcgggaggtaaccggagttacaggttcggtacaccgttcttcgacgtccaccggtacaaccggggaccgtcctacggtttcccgtccccgtttaccccncggtaccctaaacccttccgaccgtaagccgtaaccgcccggttaggcccggggcaacccgcggggcccgttccgg

SEQ ID NO: 307228 - DNA, 626 bp, Homo sapiens
  misc_feature: GZ8MTXP02GLP0L.3.20.B09.1.454.CMB.2.raw
  modified_base (258)..(258): a, c, t, g, unknown or other
  misc_feature (258)..(258): n is a, c, g, or t
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtcccctcacctgcactgtctctggtgctccatccgtccttactactgganctgtctccggcacgcccccgagggaggactggagctatagttgggtattgtcttcgacgaggtgggaggactagacctacaaccgccctccgtcgacggcgtcgggtacacctagtactacgagtacgaacaccgtaccgaaagcgtaccaagtttcctcccttacgaaagtcgtggacggtctggtacgcggcgccgcaggaccgacgggtccgtagttactacgtgacgaccggagacgtaccggacgaccaaacggacgtaacgtaccggggtgacctaaaccgttccgttaagttcgttccgttttagtaacgttacggttcggtacgggggttacccgaaaagggtacgtaaacgtttccggg

SEQ ID NO: 307229 - DNA, 584 bp, Homo sapiens
  misc_feature: GZ8MTXP02HBREH.3.20.B09.1.454.CMB.2.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
tcagagacgcactccacgaccggtgctcgatttagtgtagtgtgaagggacagggtctccgaaggcttcaccagtcctggacctcctgtgcaaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtctanactgganctgctccggcacgccccgagggaacggatgagcatagtagggtatgtacttacactagtgggagactggaacctaacaaaccgtccctacctcgaggtagtcggtacacctatacnagtanaacgacgtaccaaagtacacctaagtcctacccagaacgngtaggacggtcngtgacgcgacgacgacgacgacgtacgtacgtagttacgtagtacgacgacgtacgtacggacgaacgaacgaacgtaacgtacggacgacgtaactacgtacgtacgttacgttagtaagtacgtacgtacggaacgaacggtaacgtaacgtacg

SEQ ID NO: 307230 - DNA, 569 bp, Homo sapiens
  misc_feature: GZ8MTXP02JDDDT.3.20.B09.1.454.CMB.2.raw
tcagagacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtgctcatccgtcttactactgagctggctccggcacgcccccgagggaacggacgtggagcatattggtatgtctttcacaggtggagactgactacacgcctcctcacggacgtcgggtacaccgatactcagtagactacgtaccaaagacgaccacgttcctcccgtagaacgcgtaggaggctggtgacgcgccgacgagaccgacggccgttagtacgttacgtgtagccgagacgtcggccgacaacgacgtacgtaggtcggacctaaacgtccgtatacgtcgttttagaattacgtcgtacggggaccgaaagggtacctagttaccgg

SEQ ID NO: 307231 - DNA, 746 bp, Homo sapiens
  misc_feature: GZ8MTXP02JNVKH.3.20.B09.1.454.CMB.2.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (281)..(281): a, c, t, g, unknown or other
  misc_feature (281)..(281): n is a, c, g, or t
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccactccctccctgtctgcatctggtaganacagacgtcacatcagttcggccgganaagtcagancattgcgttactaatttaagttgactcagacaacaaacgaggaaacnccccgtaaagcctcgtgtaactcgtatcggcttaggtaaaccttccgttaacgtttaggaaccggtaaaacgggttccggggtaaccccccctaagttaccgtaaacggttaccggtaggttaacggccgtaggggtacggttaacgtccggttaacggggaacttacgggtttaactttacgtaacccgttacctaaaccgtactacgacgtaccgggtaccttacgaaccgtaccctaaaggttacgttaacgttttacgaccgttaactaccgtacttaccgtacgtaacgaaacgtacgtacggtacgacgtacaccgtaacctccctaaccgttaccggttaccggttaccggggaaccggggtaaacggggaaccccgttaaacgggggtacgggaaaacgtaaaccgtaaccggtaaaaacggtttccgacgggtttaccggacgtacggttaacccc

SEQ ID NO: 307232 - DNA, 673 bp, Homo sapiens
  misc_feature: GZ8MTXP02HBBZV.3.20.B09.1.454.CMB.2.raw
tcagagacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatcgacccagtcctccactccctccctgtctgcatcgtagtaggagacagacgtaccacctatcacgttcggccggactaagtcgagagtactagttacgtcgttattaatttaagtgtatacacgacaaacgaaaccgaggaaccaccctaagcctacgtagactctatgctacgtactacctacgttagacgtaaacggtccggtacccagtacgtaaggtcgaggtacggactagggtagtacgtcggacgtactacgttactttaccaaccttactaacccgtagtacgtaccggtacgttactccggaacctaacggtagtaacttattaccgacttaaccgtctaagttactacgaaaccagtacgtagacgtaacgaccgaccgtaccgtacccttaacggcccgtttaacgggggttacccggaacggggtaaaccgggttaacgacgggggtaaccgtaaacgaagtaaaaccccggagttaccggttacggcggttaccacggtaaccc

SEQ ID NO: 307233 - DNA, 630 bp, Homo sapiens
  misc_feature: GZ8MTXP02FZM28.3.20.B09.1.454.CMB.2.raw
tcagagacgcactccacgaccggtgctcgattttagtgtagtgtgaagggacagggtctccgaaggcttcacctgtcccaggtgcagctgcaagagtcgggcccaggactgatgaagccttcggagaccctgtccctcacctgcactgtctctggtggctccatccgtccttactaccggagctgctccggcacgccccgaggaggactggagcatattgggtatgttcttcacgaggtggagactgactacacgcctcctgaggtagtcggtacaacctagtactcgaagtacgaacaacgtaccaagacgcctagttcctccgtagaagcgtaggacggctggtacgacgccgccgacgacgaaccgtccgggtacgttagttaacgttacgttggcggacgtaaggtacgtaccggaccgaacaaagacgtacgtagtcgacctaaacgtcctagttcgtactttagattacgacggtacgggaaccgaaaggggacttaacggttccgtacctaccgtcttactcacgtcctaaccgacgaccgtccacgttccggtaccctcccgtgcccctaccgccacgtaacgcctaaccgaccgtcggaccggaccacgccggccgtccgg

SEQ ID NO: 307234 - DNA, 523 bp, Homo sapiens
  misc_feature: GZ8MTXP01C07WX.44.37.D04.1.454.CMB.2.raw
  modified_base (262)..(262): a, c, t, g, unknown or other
  misc_feature (262)..(262): n is a, c, g, or t
  modified_base (327)..(327): a, c, t, g, unknown or other
  misc_feature (327)..(327): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaanagaaacctggccaggctcccaggctcctcatctatgatgcatccaacagggtcactggcaccccngacaggttcagtggccaggtggtctgggacaagcttcactctcaccgtcagcaatgtacagcctagaagtatttgctagtttattactgtcagcaggtcgttcctccgacggccgtctcgacgtttcgggcgggggtaccgagggtggagaagtcgagacgacgtgtgcgttgcncatctgtcttcncttctcccg

SEQ ID NO: 307235 - DNA, 526 bp, Homo sapiens
  misc_feature: GZ8MTXP01DR5GR.44.37.D04.1.454.CMB.2.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (380)..(380): a, c, t, g, unknown or other
  misc_feature (380)..(380): n is a, c, g, or t
  modified_base (445)..(445): a, c, t, g, unknown or other
  misc_feature (445)..(445): n is a, c, g, or t
  modified_base (479)..(479): a, c, t, g, unknown or other
  misc_feature (479)..(479): n is a, c, g, or t
tcagacagtatatacacgaccggtgctcgatttagtagcatactgttgggtttgggggaggaactgctcagttaggacccagagggaaccatggaagccccagctcagcttctcttcctcctgcctactctggctcccagagatcaccggagatattgtgttgacacagtctccaggcaccctgtctttgtctccgagggganagacgccacctctcctgtagggccagtcggagtgttgctaagtacctagcctaggtaccaaanagaaacctggccaggctcccaggctcctcatctatgatgcatccaacagggtcactggccacccagacaggttcagtgccaggtggtctgggacaagacttcactctcaccgtnagcaatgtacagctgaagtatttgacttagtttatactgtcagtcaggtcgttctccgacggccnctcgtacgtttcgggcggggtacaaggtcggagntcgagacgacgtgtgcgttgacaactgtctgtcttctcttcgtcccg

SEQ ID NO: 307236 - DNA, 550 bp, Homo sapiens
  misc_feature: GZ8MTXP01EE30M.44.37.D04.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtacctagcctggtaccaanagaaacctggccaggcnccaggctctcatctatgatgcatccaacaggtcactggccacccagacaggttcagtgccaggtggtctgggacaagacttcactctcacgtnagcaatgtacagctagaagtatttgctagtttattactgtcagcaggtcgttcctccacggccgctcgtacgtttcggggcgggggtaccagggtcggagaagtcgaaggacgttaaacgtggtcgggcttcggactaaccgtattcgttcgttccttactaacgttcccttccccg

SEQ ID NO: 307237 - DNA, 532 bp, Homo sapiens
  misc_feature: GZ8MTXP01B5OTM.44.37.D04.1.454.CMB.2.raw
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (446)..(446): a, c, t, g, unknown or other
  misc_feature (446)..(446): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggctccccaggctcctcatctatgatgcatccaacngggtcactggcaccccagacaggttcagtggccagtgggtctggggacaagacttcactctcacgtcagcaaangtacngctgagattttgctagtttatactgtcagctaggcgtttcctccaggcccgtcctcncgtttacggggcgggggtaccaagggtgaggaatcaggacaacgtgtggcttgctaaccgatcgtgtctttcaacttccttccccg

SEQ ID NO: 307238 - DNA, 548 bp, Homo sapiens
  misc_feature: GZ8MTXP01EW8CK.44.37.D04.1.454.CMB.2.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (489)..(489): a, c, t, g, unknown or other
  misc_feature (489)..(489): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaaagtacctagcctggtaccaanagaaacctggccaggctcccaggctcctnatctatgatgcatccaacngggtcactggccacccagacaggttcagtggccaggtgggtctggggacaagacttcactctcaccgtcagcaaatgtacagcctagaagtattttgctagtttatactgtctagcagggtcgtttcctccgaggccgtctcgtacgtttcggggcggggggtaccaagggtgggagngtcgaggacgaaacgtggtgggcttggacaacctatcgtgtcttcaacttccgttcccg

SEQ ID NO: 307239 - DNA, 531 bp, Homo sapiens
  misc_feature: GZ8MTXP01DGS8K.44.37.D04.1.454.CMB.2.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggatcccagagatcaccggagatattgtgttgacacagtctccaggcaccctgtctttgtctccagggganagagccacctctcctgtagggccagtcggagtgttgctaagtacctagcctggtaccaacagaaacctggccaggctcccaggctcctnatctatgatgcatccaaangggtcactggccaaccccagacaggttcagtggccaggtggtctgggacaagacttcactctcaccgtcagcaaatntacagcctagaagtatttgctagtttatactgtcagcaggtccgttcctccgacggccnctcgtacgtttccggggcgggggtaccaagggtggagaatcgagacgaacgtgnggcgttgcaacatctgtcttctcttcctcccg

SEQ ID NO: 307240 - DNA, 627 bp, Homo sapiens
  misc_feature: GZ8MTXP01BT8OE.44.37.D04.1.454.CMB.2.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (385)..(385): a, c, t, g, unknown or other
  misc_feature (385)..(385): n is a, c, g, or t
tcagacagtatatacacgaccggtgctcgatttagtagcatactgttgggtttgggggaggaactgctcagttaggacccagagggaaccatggaagcccagctcagcttctcttcctcctgctactctggctcccagagatcaccggagatattgtgttgacacagtctccaggcaccctgtctttgctccagggganagagccacctctcctggtacgggccaggtcggagtgttgactaagtacctagcctgggtaaccaacagaaacctggaccaggcctcccgaggcctcctnatctaatgatgcatccaaagnggtcactggccacccagacaggttcagtcggcaggtggctgggacaagacttcactctcgaccgtnagctaatcgtacacgtacgtagtaagttagtttagactttaagtttacttacgttgtacacgtcgtacggtccgtttcccgtaccgaccggtcccgtccgttaccggtaccggtttccgggggaccgggggtaaccgtaagggtcgggaagtaacgtacgaacggtaacgttacgtcggtcggttaccgttcgaccgtaacctagttccgttacgttccgttactaaccgtttcccgtcccg

SEQ ID NO: 307241 - DNA, 610 bp, Homo sapiens
  misc_feature: GZ8MTXP01B866E.44.37.D04.1.454.CMB.2.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctggccaggctcccaggctcctcatctatgatgcatccaaacgagggtcacgtcggaccaccccagacaggttcagtggccaggtgggtctgggacaagacttcactcncaccgtcagcaatgtacagcctagaagtatttagctagtttatactgtcagcagggtccgtttcctccgacggtcccgtcctcgtaccggtttccgggggaccggggggtaaccgtaaggggtcgggaagtaacgtcgaaggaaaccggaaaccgttgggtcgggccgttggaccctaacccgtagttccgttcggttccctttaccgtaaccgtttccccgtttccccccgg

SEQ ID NO: 307242 - DNA, 610 bp, Homo sapiens
  misc_feature: GZ8MTXP01D0TT0.44.37.D04.1.454.CMB.2.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (395)..(395): a, c, t, g, unknown or other
  misc_feature (395)..(395): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctggtagggccaggtcggagtgttgctaaagtacctagcctaggtaccaaacgagaaacctggccaggctcccaggctcctnatctatgatgcatccaacgagggtcacgtggacccaaccccagacaggttcaggtggccaggtgggtctgggacaagtacttcactctaccaccgtnagctaatgtacagctagaagttattttagacttagtttactacttgtcagctacgggtcgtttcctccgacggtcccgtcgttccgtaccggttttccgggggaccgggggtaacccgaaaggggttcggaaggtaacgtacgaaggtacggttaaacgtggtcggccgttggaccaacctatcgttcgttccttctaaccgttccttaaccccg

SEQ ID NO: 307243 - DNA, 670 bp, Homo sapiens
  misc_feature: GZ8MTXP01B9N2D.44.37.D04.1.454.CMB.2.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccacctntcctggtagggccagtcggagtgttgctaagtacctagcctaggtaaccaaacagaaacctggccaggcnccaggctcctcatctatgatgcatccaanagggtcactggaccaccccagacaggttcagtgcaggtggtctgggacaagacttcactctacaccgtanacgactaagtcgtaacacgtacgtagtaaagttagtttacgtacgtttaagttttaacttacgttcgtacgtaacgtcgtaccggggttcccgtttacccgtaccgacgggtccccgttccgttacccggttaccggggtttaccggggggaccggggggtaaaccgtaacggggtacggaaggtaacgtacggaaacggtaaaccggttaacgttcgggtcggttccgttcggacctaaccgtacgtttccgttacgttcctttacctaacccgtttcccgttccccg

SEQ ID NO: 307244 - DNA, 521 bp, Homo sapiens
  misc_feature: GZ8MTXP01ANN6X.44.37.D04.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (376)..(376): a, c, t, g, unknown or other
  misc_feature (376)..(376): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtacctagcctggtaaccaanagaaacctggccaggctcccaggctcctcatctatgatgcatccaacagggtcactggccaccccagacaggttcagtgccaggtggtctgggacaagacttcactctcaccgtnagcaaatgtacagctgaagtattttgctagtttattactgtcagcaggcgttcctcgacggccgctcgacgtttcgggcgggggtaccaagggtgagaatcgagacgaacgtgtgcgttgcaaccntctgtcttcncttctcccg

SEQ ID NO: 307245 - DNA, 538 bp, Homo sapiens
  misc_feature: GZ8MTXP01DWGFY.44.37.D04.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (326)..(326): a, c, t, g, unknown or other
  misc_feature (326)..(326): n is a, c, g, or t
  modified_base (512)..(512): a, c, t, g, unknown or other
  misc_feature (512)..(512): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccacctctcctgtagggccagtcggatgttgctaagtacctagcctaggtaccaaanagaaacctggccaggcnccaggctcctcatctatgatgcatccaacagggtcactggcaccccngacagttcagtggcaggtgggtctggggacaagacttcactctcaccgtcagcaatagtacagctgaagtattttagtctagtttattactgttcagtcacggtcgttcctccgacggccgcgtcgtacgtttcgggcgggggtaccgtagggtggagaagtcgagacgacgtagtggcgttcgcncaaatctgtcttctaacttcgtcccg

SEQ ID NO: 307246 - DNA, 522 bp, Homo sapiens
  misc_feature: GZ8MTXP01AQLH5.44.37.D04.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (378)..(378): a, c, t, g, unknown or other
  misc_feature (378)..(378): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggctcccaggctcctcatctatgatgcatccaacagggtcactggcaccccagacaggttcagtggccaggtgggtctgggacaagacttcactctcaccgtnagcaaatgtacagcctgaagtatttgctagtttatactgtcagcaggtcgttcctccacggccgctcacgtttcgggcgggggtaccaaggtggagaatcagacgacgtgtggcttgcaaccatctgtcttcaacttcttcccg

SEQ ID NO: 307247 - DNA, 559 bp, Homo sapiens
  misc_feature: GZ8MTXP01A7FZQ.44.37.D04.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (380)..(380): a, c, t, g, unknown or other
  misc_feature (380)..(380): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccaggtcggagtgttgctaagtcctagcctggtaaccaanagaaacctggccaggcncccaggctcctnatctatgatgcatccaaacagggtcacgtggccaccccagacaggttcagtgccaggtgggtctgggacagacttcactctcaccgtnagcaatgtacagcctagaagtattttagacttagtttattacgtgtacagtcaggtcgttcctccgacggtccgcgtccgtacgtttcggggcgggggtaccaagggtggagaatcgaagacgaacgtggtacggcttcggcctaacctattcgtcgttcttctaacgttccttccccg

SEQ ID NO: 307248 - DNA, 582 bp, Homo sapiens
  misc_feature: GZ8MTXP01AV816.44.37.D04.1.454.CMB.2.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtagggccaggtcggagtgttgctaagtacctagcctggtaccaaacagaaacctggccaggcncccaggctcctcatctatgatgcatccaacngggtcactggaccaccccagacaggttcaggtgccaggtggtctgggacaagacttcactctcacccgtnacgactaatcgtacacgtctagtaagttagtttgacttagtttattacgttcgtacagtcgtacgggtccgttcctccgtacggccgtcgtcgtaccggttcggggacgggggtacgtagggtcggaaggaacgtacgaggtacgacgtggtcgcgttcgaccgaactcgtcgtcgttccttactccttccgtcccg

SEQ ID NO: 307249 - DNA, 550 bp, Homo sapiens
  misc_feature: GZ8MTXP01ERR37.44.37.D04.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccaccctctcctgtagggccaggtcggagtgttgctaagtacctagcctggtaccaanagaaacctggccaggctcccagctctnatctatgatgcatccaacngggtcacgtggccacccgagacaggttcagtggccaggtggtctgggacagacttcactctcacgtnagcaatgtacngctagaagtattttgcttagtttattactgtcagctaggtcgtttcctccgaggcccgtctccgtacgtttcggggacgggggtaccaagggtggagaacgtcgagacgacgtggtgacgttgaccgtaacctagttcgtgtccttctaacgttccgtccccg

SEQ ID NO: 307250 - DNA, 567 bp, Homo sapiens
  misc_feature: GZ8MTXP01DLGIE.44.37.D04.1.454.CMB.2.raw
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctctgtagggccagtcggagtgttgctaagtacctagcctggtaccaaacagaacctggccaggcnccaggctcctcatctatgatgcatccaaacgagggtcacgtggcccaaccccagacaggttcaggtggccgaggtgggtctggggaacaaggacttcactctacaccgtcaagcaaatgtacagcctagaagttatttagacttagtttattactgtcagcaggtccgttcctccgacggccgtcgttccgtaccggtttcggggccgggggtaccgtaagggtggaggaatcgagacgttaacgtggtgcgttgaccaactatcttgtcttctaacttccgtccccg

SEQ ID NO: 307251 - DNA, 538 bp, Homo sapiens
  misc_feature: GZ8MTXP01DC22V.44.37.D04.1.454.CMB.2.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgtctccgagggganagagccacctctctggtagggccagtcggagtgttgctaaagtacctagcctaggtaacccaaanagaaacctggccaggcnccaggctcctcatctatgatgacataccaagagggtcacgtcggaccaaccccgagactaggttcaggtggcaggtggtctgggacagacttcactcacacgtcagacaatcgtacagctagaagttatttagtactagtttatactgtacagtcacggtcgttcctccgacggcctctcgtacggttcggggcgggggtacagggtgagaatcgagacgagtgtgcgttgcaactntctntcttctcgttctcg

SEQ ID NO: 307252 - DNA, 549 bp, Homo sapiens
  misc_feature: GZ8MTXP01A74O9.44.37.D04.1.454.CMB.2.raw
  modified_base (202)..(202): a, c, t, g, unknown or other
  misc_feature (202)..(202): n is a, c, g, or t
  modified_base (316)..(316): a, c, t, g, unknown or other
  misc_feature (316)..(316): n is a, c, g, or t
  modified_base (389)..(389): a, c, t, g, unknown or other
  misc_feature (389)..(389): n is a, c, g, or t
  modified_base (455)..(455): a, c, t, g, unknown or other
  misc_feature (455)..(455): n is a, c, g, or t
  modified_base (514)..(514): a, c, t, g, unknown or other
  misc_feature (514)..(514): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctgtagggccagtcggagtgttgctaagtacctagcctaggtaccaacagaaacctggccaggctcccaggcctcctcatctatgatgcatccaaacgngggtcacgtggaccaccccgagacaggttcaggtggccaggtggtcgtgggacaagacttcactctcaccgtnagctaaatcgtacagtcctagaagttagttttgacttagtttattactgtcagtcaggtccgttcnccgaggtccgctcgtacggtttcggggcgggggacaagggtgagaatcgagacgttagngtggcttgacaacgntctgtcttcncttccgtccc

SEQ ID NO: 307253 - DNA, 524 bp, Homo sapiens
  misc_feature: GZ8MTXP01DOCZU.44.37.D04.1.454.CMB.2.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggganagagccacctctcctgtagggccagtcggagtgttgctaagtacctagcctggtaccaacagaaacctggccaggctcccaggctcctcatctatgatgcatccaangggtcactggcaccccagacaggttcagtgccaggtgggctgggacagacttcactctcaccgtnagcaaatgtacagctagaagtatttgctagtttatactgtcagcaggtcgttcctccacggccgctcgacgtttcgggcgggggaccaagggtggagaagtcagacgaacgtggtggcgttcgcaacatctgtcttctaacttctccccg

SEQ ID NO: 307254 - DNA, 555 bp, Homo sapiens
  misc_feature: GZ8MTXP01A8GUV.44.37.D04.1.454.CMB.2.raw
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagagccaccctctcctgtagggccagtcggagtgttgctaagtacctagcctggtaccaanagaaacctggccaggcncccaggctcctnatctatgatgcatccaacagggtcacgtggccacccngacagttcagtgcaggtggcnggacaagactcactcncacgtnagcaatgtacagcctagaagtattttagcttaagtttattacgtgtacagtctacggtccgttcctccgacggcccgcgttccgtacgtttccgggggcgggggtaaccgaagggtcggagaacgtcgaggacgaacgtggtggcgttgccgaactatcgtcgtcttctaacgttccttcccg

SEQ ID NO: 307255 - DNA, 543 bp, Homo sapiens
  misc_feature: GZ8MTXP01AEBUH.44.37.D04.1.454.CMB.2.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (377)..(377): a, c, t, g, unknown or other
  misc_feature (377)..(377): n is a, c, g, or t
  modified_base (445)..(445): a, c, t, g, unknown or other
  misc_feature (445)..(445): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaaccaanagaaacctggccaggctcccaggctcctnatctatgatgcatccaacngggtcactggcacccagacaggttcagtggccaggtggtctggggacaagacttcactctcaccgtnagctaaatgtacagctgaagtatttgctagtttattactgttcagtcaggtcgttcctccgacggccncgtctacgtttcgggcgggggtaccgaagggtcggagaagtcgaggacgaaacgtggtggcgttcgcaaccgatcgtgtcttctaacgttccttcccg

SEQ ID NO: 307256 - DNA, 578 bp, Homo sapiens
  misc_feature: GZ8MTXP01CUYZT.44.37.D04.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctgtacgggccaggtcggagtgttgctaagtacctagcctggtaaccaanagaacctggccaggcnccaggctctnatcatgatgcatccaaacgngggtcacgtcggacccaaccccgagactagggttcaggtggccaggtgggtctgggacaagtacttcactctcacgtnagcaatcgtacagctagtaagtattttagacgttaagtttattacttgtacagtcgtaggtccgttcctccgacggcctctcgtacggttccggggcgggggtacaagggtggagtaagtacgaggacgaacgtgggtcgcgttcgacctaactatcgtcgttcttctaacgttcccgttaaccccg

SEQ ID NO: 307257 - DNA, 529 bp, Homo sapiens
  misc_feature: GZ8MTXP01CCGVE.44.37.D04.1.454.CMB.2.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtacctagcctggtaccaacagaaacctggccaggctcccaggctcctnatctatgatgcatccaanagggtcactggccaccccagacaggttcagtggccaggtggtctgggacaagacttnactcncaccgtnagcaatgtacagcctgaagtattttgctagtttattacgtgttcagcagggtcgttcctccgacggccgctcgtacgtttcgggcgggggtaccgagggtggagaagtcagacgacgtgtgcgttgcaaccatctgtcttctaacttctcccg

SEQ ID NO: 307258 - DNA, 557 bp, Homo sapiens
  misc_feature: GZ8MTXP01EGGG3.44.37.D04.1.454.CMB.2.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccacctntcctggtacgggccagtcggagttgttgctaagtacctagcctggtaaccaanagaaacctggccaggctcccaggctcctcatctatgatgcatccaacagggtcactggccaccccagacaggttcagtggccaggtggtctggggacaagcttcgatctcaccgtnancatnacagctagagttatttgacttagtttatactgtacagcacggtcgttcctccgacggccgtctcgtacggttcggggacggggtacgagggtggagaagtacgaggtacgttagtggtcggcgttcgaccaactagttccgttcgttcttacctaaccgttcccgtcccg

SEQ ID NO: 307259 - DNA, 650 bp, Homo sapiens
  misc_feature: GZ8MTXP01DG6LG.44.37.D04.1.454.CMB.2.raw
  modified_base (270)..(270): a, c, t, g, unknown or other
  misc_feature (270)..(270): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgaggggagagacgccaccctctcctggtacgggccagtcggagtgttgactaaagtacctagcctggtaacccaaanagaaacctggccaggctcccgaggctctcatctatgatgcatccaacgaggtcacgtggccacccagacaggttcagtggccaggtggtctgggacagtacttcgactcacaccgtcagacaagtgtacacgtcgtagaagttacgtttagtacgttagttttaacttacgttgtacgtagtcgtacggttcccgttcccgtaccgacggtccgtaccgttccgttaaccgggtttccgggggaccggggggtaacccgtaaaggggtcgggtaacggtaacgtaaccggaacgggtaaccggttaaacgttgggtcggttacggttcggaccctaaccgtacttccgttacgttccttctaacgttcccgtttcccccg

SEQ ID NO: 307260 - DNA, 559 bp, Homo sapiens
  misc_feature: GZ8MTXP01AZPAR.44.37.D04.1.454.CMB.2.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (388)..(388): a, c, t, g, unknown or other
  misc_feature (388)..(388): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctggtagggccaggtcggagtgttgctaagtacctagcctggtaccaanagaaacctggccaggcctcccaggctcctnatctatgatgcatccaaacgngggtcactggcccaccccagacaggttcaggtggccaggtgggtctgggacaagacttcactctcaccgtnagcaatgacagctagaagtatttgcttagtttacttactgtcagcagggtccgttcctccgacggtcctcgtcgtacggtttccggggcgggggtaccgaagggtggagtaagtcgaggacgaacgtggtcggcgttgcctaacatcttcgtcttctaacttccgttcccg

SEQ ID NO: 307261 - DNA, 660 bp, Homo sapiens
  misc_feature: GZ8MTXP01BVT4X.44.37.D04.1.454.CMB.2.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggatcccagagatcaccggagatattgtgttgacacagtctccaggcaccctgtctttgtctccagggganagagccaccctctcctgtagggccaggtcggagtgttgctaagtacctagcctaggtaccaaacagaaacctggccaggccncccaggcctccncatctatgatgcatccaagngggtcacgtcggacccaccccagacaggttcagtggccagggtgggtctggggacaaagtaccttcaacttccgaccacccgtcaagtactaatcgtaacagtccgtagaacgttattttagacttaagttttactacttagttccaaggtcctacggggtccgtttccctaccggacgggtcccgccgttaccgtacggtttccgggggaccggggggtaacctaaaggggtgggaacgtaacgtacggacggtaaaccggttaacgttcggtcgggttaccgttcggaccctaaccggtcttccgttcgttccctttacctaaccgttttccccgttcccccg

SEQ ID NO: 307262 - DNA, 614 bp, Homo sapiens
  misc_feature: GZ8MTXP01B8TRI.44.37.D04.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagagccaccctctcctggtagggccaggtcggagtgttgctaagtacctagcctggtaaccaanagaactggcagcnccagctctcatcatgatgcatccaacgagggtcactcggacccaaccccgagacgtaggttcaggtcggaccagggtgggtcgtcgggggacaaggtaccttcactcctcgaccgtacagcaaagtcgtaacgagccgtagaagttagttttagacttaagttttattactagttacagtcgtacgggtcgtttccctccgacggtcccgtccgttccgtaacggtttccgggggaccggggggtaaccgtaaggggtaggaaggtaacgtacgaacggtaacgaacgttggtggttcgttgcctaacattcgtcgtcttactcgttccttcccg

SEQ ID NO: 307263 - DNA, 537 bp, Homo sapiens
  misc_feature: GZ8MTXP01DTC19.44.37.D04.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
tcagacagtatatacacgaccggtgctcgatttagtagcatactgttgggtttggggaggaactgctcagttaggacccagacggaaccatggaagccccagcgcagcttctcttcctcctgctactctggctcccagagatcaccggagatattgtgttgacacagtctccaggcaccctgtctttgctccgagggganagacgccaccctctcctggtagggccagtcggagtgttgctaaagtacctagcctggtaaccaaanagaaacctggccaggctcccaggcctcctcatctatgatgcatccaaacngggtcactggccacccagacaggttcagtgccaggtgggtctgggacaagacttcgactctcaccgtcagctaaatgtacagacctagaagttattttgacttagtttattactgtcagcaggtcgtttcctccgaggccgtctctacggtttcgggcgggggtaccaagggtgagaatcgagacgacgtgtggcttgcaacntctgtcttntcttctccg

SEQ ID NO: 307264 - DNA, 623 bp, Homo sapiens
  misc_feature: GZ8MTXP01ATCO9.44.37.D04.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (409)..(409): a, c, t, g, unknown or other
  misc_feature (409)..(409): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcacctgtctttgtctccgagggganagacgccacctctcctgtacgggccagtcggagtgttgactaagtacctagcctaggtaaccaaanacgaaacctggccaggcctcccgaggcctcctcatctatgatgacataccaaacgcgggtcacgtcggacccaaccccgagaccgtagggttcaggtcggcagggttgggtctggggacaagtacttcacttccacgaccgtnagactaaagtcgtacacgtctagaagttagttttagacttagtttacttacgtcgtacagtctacgggtcgttcctccgtacggcccgtccgttcgtaaccgggtttccgggggacgggggtaaccgtaagggtcggaagaacgtacgagaacggttaacgtggtcggacgttcgaccgaactacgtctcgttcttctaacgttcccgttcccg

SEQ ID NO: 307265 - DNA, 564 bp, Homo sapiens
  misc_feature: GZ8MTXP01C901G.44.37.D04.1.454.CMB.2.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccagggganagacgccaccctctcctggtacgggccagtcggagtgttgctaaagtacctagcctggtaccaanagaaactggccagcnccagctcnatctatgatgcatccaanggtcactggccaaccccagacagttcagtggccaggtgggtcgtagggacaagtaccttcactctcaccgtnacgcaaatcgtacagctagaattagtttagtacttagtttaatacgtgtacagtctagggtcttccgtcgacggcctctccgtacggtttccggggcgggggtaaccgtagggtggtagaagtcgagtacgacgtaggtgcgttcgacgaacctattcctcgttcttactcgttcccgttaacccg

SEQ ID NO: 307266 - DNA, 650 bp, Homo sapiens
  misc_feature: GZ8MTXP01EQ2DV.44.37.D04.1.454.CMB.2.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgtctccgagggganagacgccaccctctcctggtacgggccaggtcggagttgttgactaaaggtacctagcctaggtaaccaaacagaaacctggccaggcnccgaggcctccncatctatgatgcactccaacgagggtccacgtcggcccaaccccgagacgtaggttcaggtggcccaggtgggtcgtgggacaaggtactcactctccacgtcagacaatgtacagtcctagtaagttattttacgacttagtttacttactcgtacaagtctacggggttcccgttccgtcccgacgggtcccgtacgttccgttaaccgggtttccgggggaccggggggtaaccgtaaagggggtcgggaaggtaacgtacggaaacgtaacggttaaacgtgggtcgggttacgttcggacctaaccagttcttacggtcttacgtaacttcccgttaaccccg

SEQ ID NO: 307267 - DNA, 770 bp, Homo sapiens
  misc_feature: GZ8MTXP01D6SRE.44.37.D04.1.454.CMB.2.raw
  modified_base (269)..(269): a, c, t, g, unknown or other
  misc_feature (269)..(269): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgaggggagagagccaccctctcctggtacgggccaggtcggagttgttgactaagtacctagcctaggtaaccaanacgaaacctggaccaggcctaccgaggcctcctcatctatgatgcactaccaacgagggtcacgtcggcccaacccgagactaggttcaggtcggaccgtagggtcggggtacgtggggaacctaaacggtacctttccgaacctttcccgtacccgtaacccgggttacaacgggaccttaaagttcgttaaaccgacggtacccgttaaggtaaacgtttagtttttttacggaaccttttaaggtttttaactttaaccgttggttactaaacgtccgttaacgggggttcccggttttaccccttaccggaaccgggtcccgtaccgttaccggttacccgggttttaccggggggaccggggggtaaacccgtaaggggttacgggaaggtaacgttacggaacggaaaccggttaacgttgggtcgggttacgttcggacccgtaacctacttccgttacggttccttacctaacctttccccggttaacccccg

SEQ ID NO: 307268 - DNA, 690 bp, Homo sapiens
  misc_feature: GZ8MTXP01BYY3W.44.37.D04.1.454.CMB.2.raw
  modified_base (202)..(202): a, c, t, g, unknown or other
  misc_feature (202)..(202): n is a, c, g, or t
  modified_base (417)..(417): a, c, t, g, unknown or other
  misc_feature (417)..(417): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctggtagggccaggtcggagtgttgctaagtacctagcctggtaaccaaacagaaacctggaccaggcctcccgaggcctcctcatctatgatgcactccaacgagggtccacgtggacccaaccccgagacctagggttcaggtcggacctagggtggggtctgggggacaagtaccttcgacttcctacgacccgtnaagactaaattcgtaacacggtcctaggtaaacgttagtttttacggactttaagttttacttaaccgtggttaccaaggtccgtacggggttccgtttaccccgtccgaacgggtccccgtcttccggtaccggttttcccggggggaccgggggtaacctaaagggggttccggaagtaacgttccggaaaggtaacccgttaagtcggtcgggccttcggaccctaaccgtattccgttgtcccttctaaccgtttccccttaaccccgg

SEQ ID NO: 307269 - DNA, 602 bp, Homo sapiens
  misc_feature: GZ8MTXP01ADZ8I.44.37.D04.1.454.CMB.2.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (390)..(390): a, c, t, g, unknown or other
  misc_feature (390)..(390): n is a, c, g, or t
  modified_base (575)..(575): a, c, t, g, unknown or other
  misc_feature (575)..(575): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctggtagggccaggtcggagtgttgctaagtacctagcctggtaaccaanagaaacctggccaggcncccaggctcctcatctatgatgcataccaacgagggtcacgtggaccaccccgagacaggttcaggtggcaggtgggtcgtgggacaagtacttcactctcaccgtnagcaaatcgtacagtcctagtaagttattttagacttaagtttattacgtgttacagtcgtaacgggtccgttcccgtccgacggtcccgtcgttcgtaccggtttccgggggaccggggggtacctaaggggtcgggagtaacgtcgaaggacgttaacgtggtcgggcttcggcctaaccgtntcgttcttcttactccgttcccgtccg

SEQ ID NO: 307270 - DNA, 617 bp, Homo sapiens
  misc_feature: GZ8MTXP01CTWDI.44.37.D04.1.454.CMB.2.raw
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (583)..(583): a, c, t, g, unknown or other
  misc_feature (583)..(583): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtacgggccaggtcggagtgttgactaagtcctagcctggtaaccaanagaactggcaggcnccaggctctcatctatgatgcactaccaacgagggtcacgtggacccacccagacaggttcaggtcggcctaggtgggtctggggacaacgtacttcactctacaccgtcagcaaatcgtacagtcctagaacgttatttcgacttaagttttactactgtactaagccgtaggggttcccgtttccgtaccgagggtccccgtcgtccgttaccggtttccgggggacgggggttaaccaagggggtcggaagtaactacgacggtaaccgaagttcgggtggcttcggacctaaccgtnttcgtcggttccttactaaccttcccgtaacccg

SEQ ID NO: 307271 - DNA, 532 bp, Homo sapiens
  misc_feature: GZ8MTXP01ACZIF.44.37.D04.1.454.CMB.2.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
  modified_base (511)..(511): a, c, t, g, unknown or other
  misc_feature (511)..(511): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgctccgagggganagagccaccctntcctggtagggccaggtcggagtgttgctaagtcctagcctggtaccaanagaacctggccaggcncccaggctcctnatctatgatgcatccaaagngggtcacgtggacccaccccgagacaggttcaggtggccaggtgggtctggggacaagcttcactctcaccgtnagcaatgtacagtctagaagtatttgacttagtttattactgtcagtcacggtcgttccncgacggccgctcgtcgttcgggcgggggtacagggtcggagntcgagacgacgtgtgcgttgcaacntctgtcttctcttccgtcccg

SEQ ID NO: 307272 - DNA, 615 bp, Homo sapiens
  misc_feature: GZ8MTXP01BFFOQ.44.37.D04.1.454.CMB.2.raw
  modified_base (246)..(246): a, c, t, g, unknown or other
  misc_feature (246)..(246): n is a, c, g, or t
  modified_base (386)..(386): a, c, t, g, unknown or other
  misc_feature (386)..(386): n is a, c, g, or t
  modified_base (614)..(614): a, c, t, g, unknown or other
  misc_feature (614)..(614): n is a, c, g, or t
tcagacagtatatacacgaccggtgctcgatttagtagcatactgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccattcacatctcaganacaattccaagaatatgcttgtattgacaaatgaacagcgtagagagttagacgacacgttctgtttattacgtgtgcggacgggggtacctacgaaaggtaaacggtcgggaatcgaactaaactatactattgaatgntgtcgtggggcgagggggacgtcgggtcaccgttctcctgacgtccttacccgaaccgaacgggtccctacgtccggttcccttcccccgtggtcccgcccttcggcctcccgaggtaccgccgtaccgtcggtcggggctacgcggccggcccgtggggcttcgggccttgggtaccaacggttcttacgttcctaagtactaacgtcgttacgcggtcggttcggng

SEQ ID NO: 307273 - DNA, 572 bp, Homo sapiens
  misc_feature: GZ8MTXP01AU2Q2.44.37.D04.1.454.CMB.2.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (384)..(384): a, c, t, g, unknown or other
  misc_feature (384)..(384): n is a, c, g, or t
  modified_base (544)..(544): a, c, t, g, unknown or other
  misc_feature (544)..(544): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctcgagggganagacgccaccctntcctggtagggccagtcggagtgttgactaagtacctagcctggtaaccaaacagaaacctggccaggcctccccaggcctccncatcatgatgcatccaacngggtcacgtggccacccagacaggtcagtggccaggtggtctgggacaagaccttcactctcaccgtnagcaaatcgtacagctagaagttattttgacttagtttatactgtacagtcacgggtccgttcctaccgagggccctctccgtacggtttcgggggaccgggggtaccgtaagggtgggagaactacgaggaaccgagtaggtcggcttggcctaacgtnttctgtctttacgaactttccgtccccg

SEQ ID NO: 307274 - DNA, 622 bp, Homo sapiens
  misc_feature: GZ8MTXP01CKRC4.44.37.D04.1.454.CMB.2.raw
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagattattgtgttgacacagtctcaggcaccctgtctttgtctccgaggggagagacgccaccctctcctggtagggccaggtcggagtgttgctaaagtacctagcctaggtaaccaaacagaaacctggccaggctcccgaggctcctnatctatgatgcatccaaacgtgggtcacgtcggacccaaccccagactaggttcagtggccaggtgggtctagggacaagtcttcactctacaccgtnagcaatgtacagctagaatatttagctttagtttattacttgtacagtctaggtccgttcctccgacggccgtctccgtaccggtttccgggggccggggggtaaccgtaaggggtcggaagtaacgttccggaaaggtaaccgaaacgttgggtcggttccgttgggacccctaacctagttccgttacggttcctttaccgtaaccgtttcccgttcccccg

SEQ ID NO: 307275 - DNA, 624 bp, Homo sapiens
  misc_feature: GZ8MTXP01D7QQ3.44.37.D04.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (389)..(389): a, c, t, g, unknown or other
  misc_feature (389)..(389): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagacgccaccctctcctgtacgggccagtcggagtgtgctaagtacctagcctggtaaccaanagaaacctggcaggcnccagctcnatctatgatgcatccaaacgagggtcacgtggcccaaccccgagactaggttcagtggccgaggtgggtctggggacaagtacttcgactctaccaccgtnaagctaaatgtacacgtcgtagtaagttattttgacttagtttatactgtacagtctacgggtccgtttccgtaccgtacgggtcccgtccgtaccgtacggtttccggggggaccgggggtaaaccgtaaagggggtcggaaggtaacgtacggaaggtaaccggaaacgttgggtacggcgttcggacctaacctattccgttacgtcttactaaccgtttccgttaaccccg

SEQ ID NO: 307276 - DNA, 720 bp, Homo sapiens
  misc_feature: GZ8MTXP01ADKVK.44.37.D04.1.454.CMB.2.raw
  modified_base (202)..(202): a, c, t, g, unknown or other
  misc_feature (202)..(202): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (433)..(433): a, c, t, g, unknown or other
  misc_feature (433)..(433): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctggtacgggccaggtcggagttgttgactaagtacctagcctaggtaaccaanagaacctggccaggccnccaggctcctcatctatgatgactactaccgaaacgtacgggtacacgtcggacccaaccccgagtacgtacggttcgaggtcggaccgtagggtggggtcgtaggggactaacggtacccttcaccttccgtacgtacccgtnacggactaaacgttcgtaacgacgtaccgtaaggtaagttagttttacgacgtttaagttttaacttacgttgtactacgtcgtaccgggttcccgtttccgtcccgaccgggtcccgtcgttccggtaccggggtttccgggggaccggggggtaaccgtaaaggggttggaaacggtaacgtaccggaaacgggtaacgttaacgggtcggttaacggcgttccgggaccctaaccgttagttcccgttcggttccttaccgtaaccgttccccggttaaccccg

SEQ ID NO: 307277 - DNA, 689 bp, Homo sapiens
  misc_feature: GZ8MTXP01AOV04.44.37.D04.1.454.CMB.2.raw
  modified_base (202)..(202): a, c, t, g, unknown or other
  misc_feature (202)..(202): n is a, c, g, or t
  modified_base (285)..(285): a, c, t, g, unknown or other
  misc_feature (285)..(285): n is a, c, g, or t
  modified_base (320)..(320): a, c, t, g, unknown or other
  misc_feature (320)..(320): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccacctctcctggtagggccaggtcggagtgttgactaagtacctagcctaggtaccaaacagaaacctggccaggcnccaggctcctcatctatgatgacctatccaaacgngggtcacgtcggaccaccccgagactaggttcaggtggcctaggtggggtctaggggacaagtaccttcacctctacaccggtacagactaaatcgtacagtcctaggtaaagttacttttaggacttaagttttacttaacgtgttacacgtacctacgggggttcccgttacccgttccgaacggggtccctccgttaccgtacggggttttcccggggggaccggggggtaaccctaaaggggtcgggaaacgtaacgttcggaaaacgggtacccgttaaagttcggggtacggttacccgttagaccccgtaaacgtcttccgttacggttcctttaccgtaaccgttttccccttaaccccgg

SEQ ID NO: 307278 - DNA, 525 bp, Homo sapiens
  misc_feature: GZ8MTXP01A1YL1.44.37.D04.1.454.CMB.2.raw
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
  modified_base (498)..(498): a, c, t, g, unknown or other
  misc_feature (498)..(498): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcgagtgttgctaagtactagcctggtacaacagaaacctggccaggcncccaggctcctcatctatgatgcatccaaanagggtcactggcacccagacaggttcagtggcaggtggctggggacagacttcactctcaccgtcagcaaatgtacagcctgaagtattttgctagtttattaactgtacagcaggccgtttccccgaggcccgctcctacgtttcgggccggggggtaccaagggtggagtagcagacgaagttgtggcngcacaatctctctcttctcgttccgtc

SEQ ID NO: 307279 - DNA, 750 bp, Homo sapiens
  misc_feature: GZ8MTXP01DMRLV.44.37.D04.1.454.CMB.2.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtacggccagtcggagtgttgctaaagtacctagcctaggtaaccaaacgagaaacctggccaggcctccaggctcctnatctatnatgcatccaaagngggtcacgtcggacccaaccccgagtacctaggtttcaaggttcgggacctaggggttggggtaccgtagggggaacctaaacgggtaccttttccgaaacttcccgttaccgaccccgggttacaacgggtacctaaaagttcgttaaaccgaacggtaccgttaggtaaaagttacgtttttaggtacctttaaagtttttaacttaacgttcgttacgtacgtaccgtaacggggttcccgtttcccgtacccgtaccgggtcccgtcccgtttaccgtaccgggttttaccgggggaccggggggtaaacctaaggggttcggaacggtaatacggaaaggtaaccgttaaacggtcgtacgggttacgttcgaccgtaacctacgtttcgttcgttacctttacctaacgtttccccttaaccccg

SEQ ID NO: 307280 - DNA, 724 bp, Homo sapiens
  misc_feature: GZ8MTXP01ES5NQ.44.37.D04.1.454.CMB.2.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (467)..(467): a, c, t, g, unknown or other
  misc_feature (467)..(467): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctcgagggganagacgccaccctctccgtggtacgggccaggtcggagttgttgacttaaagtacctagcctagggtaacccaaacgagaaaccctggccaaggcctacccgaggcctcctnatctatgatgcataccaacgtacgggtcacgtcggacccaacccgagacctaggttcaggtcggcctagggttcggtacgtggggaactaacggtacctttcgacttctaccgaccggtcaagacctaaagtcgtacacgtaccgtagtaacgttnttttacggactttaaggtttacttaacgttcggtactagtaccgtaacgggttccgtttacccgtacccgacggggtccctccgttaccggttaccgggtttaccggggggaccggggggtaacctaagggggttcgggaacgtaacgtaccggaaacggtaccggttaaacggtcgggtacggttaccgttcggacccgtaacccctagttccgtttccggttcctttacctaacccgtttcccggttaacccccg

SEQ ID NO: 307281 - DNA, 642 bp, Homo sapiens
  misc_feature: GZ8MTXP01D6WA0.44.37.D04.1.454.CMB.2.raw
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagattattgtgttgacacagtctccaggcaccctgtctttgctccgaggggagagacgccaccctctcctgtacgggccagtcggagttgttgctaagtacctagcctaggtaaccaanagaaacctggccaggctccaggctccncatctangatgcatccaacgtaggtcacgtggacccacccagacgtaggttcaggtcggacctaggtgggtctaggggacaaggtaccttcgactctacaccgtnacgctaaatgtacagctagaacgttattttagacttaagtttatactgtacagtctacgggttccgttccgttccgacggtcccgtcgttccgtacgggttttacccgggggacggggggtaaccctaaaggggttcgggaggtaaacgttcggaaacggtaaccggttaaaggtcgggtacgggttcttcggacctaaccgtattcgttacgtctttacctaacgtttccccgtttccccg

SEQ ID NO: 307282 - DNA, 579 bp, Homo sapiens
  misc_feature: GZ8MTXP01DMVOM.44.37.D04.1.454.CMB.2.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
tcagacagtatatacacgaccggtgctcgatttagtagcatactgttggggtttgggggaggaactgctcagttaggacccagagggaaccatggaagccccagctcagcttctcttcctcctgctactctggctcccagagatcaccggagatattgtgttgacacagtctccaggcaccctgtctttgctccgaggggganagacgccacctctcctggtagggccagtcggagtgttgctaagtacctagcctaggtaccaaanagaaacctggccaggctccaggctcctnatctatgatgctactccaaacgagggtcacgtcggacccaaccccgaggtacaggtttccgaggtcggacctagggtgggtactggggaacaaggtaaccttcactctaccacgtcaagctaaatgtacaggctagaagttatttgacttagtttatactgtcagcagggtcttccctcgacgggcctactcgtacggtttacggggcgggggtactagggtgaggtaatcgagacgacgtggtgcgttgaccaactattcgtgtccttctaacgttccctccg

SEQ ID NO: 307283 - DNA, 741 bp, Homo sapiens
  misc_feature: GZ8MTXP01B4IF2.44.37.D04.1.454.CMB.2.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccaccctntcctggtacgggccaggtcggagtgttgctaagtacctagcctggtaacccaanagaaacctggccaggcncccaggctcctcatctatgatgcatccaacgagggtcacgtggaccaccccgagacctaggttcaggtcggaccgaggttgggtactgggggaactaaggtaacctttcaacttcctaccgaaccccggttcaaacggacctaaagttcggtaaaccacggtacccgttaggtaaacgttaagtttttaggaccttaaggtttttaacttaacgttcggttacaaggtaccgtacggggttcccgttttacccgtacccgaacgggtccccgtaccgttaccgttaaccgggttttaccgggggaccggggggttaacccgaaagggggttcgggaaggtaacgttaccggaaaggtaaaccggttaaacgttgggtacgggttaccgttcgggaccctaacccggtacgtttccttcggttccgtttacctaaccgttttccccggtttcccccg

SEQ ID NO: 307284 - DNA, 718 bp, Homo sapiens
  misc_feature: GZ8MTXP01BOJJE.44.37.D04.1.454.CMB.2.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtacgggccaggtcggagtgttgactaagtacctagcctaggtaaccaanagaaacctggccaggccnccgagcctcctnatctatgatcgctactaccgaaacgtacgggtccacgtcggaccccaaccccgaggtaccgtacggttcaaggttcggaccctagggtcgggtacgtggggactaaacggtacctttcaccttccgtacacccgtcaacgactaaatcgtaacagtacctagtaaacgttagttttagactttaagtttattaaccgttgtaccgtaagtccgtacgggtcccgtttcccgtaccgtaccggtccgtaccgttccggtaccggggttttaccgggggaccggggggtaacccgtaagggggttacgggaacgtaacggttacgaaacgggtaaccggaaaggttcggtcggacggttcacccgtaaccttacgttcctttcgtttaccttaccttaaccgttccccgtttaaccccgg

SEQ ID NO: 307285 - DNA, 634 bp, Homo sapiens
  misc_feature: GZ8MTXP01D5XFY.44.37.D04.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccaccctctcctggtaggccagtcggatgtgctaagtcctagctaggtaccaanagaacctgacaggcnccaggctcctcatctatgatgacataccaacgagggtcacgtcggaccaaccccgagacgtaggttcaggtgccgaggtggtcgtgggacaagtacttcnctcctacgaccgtnagcaatcgtacacgtctagtaagttattttacgtagttaagttttactacgttcgtacaagtcgtaacggtccgtttacccaccgtacgggcctaccgtccgttacggtttaccgggggacgggggttaaccgaaggggttcgaaggtaagtaacgaacggtaacggttaaccggtggtcgggttcttcggaacctaacccgtaattccgttacggttcttaccgttccgttccctttaaccccg

SEQ ID NO: 307286 - DNA, 707 bp, Homo sapiens
  misc_feature: GZ8MTXP01DMB9K.44.37.D04.1.454.CMB.2.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgcccaccctctcctggtacgggccaggtcggagttgttgactaaagtacctagccttaggtaaccaaacagaaacctggccaggcctcccgaggcctcctacatctatgatgcataccaacgtagggtcacgtggacccaacccgagactaggttcaggtcggacctagggtgggtctggggaactaacgtacttcgaacttcctccgaaccggtcaagtactaaatcggtaacacgtacctaggtaaagttatttttaggacgtttaagtttttaacttaaccgttggttaccaacggtcgtaacggggttacccgtttcccgtaccgacgggtccctaccgttaccggttaccggtttcccggggggacggggggtaacctaagggggtcggaagtaacgtacgaaacgggtaacgttaaacgttcgggtcggttacgttcggaccctaaccctagtttcccgttcggttcctttacctaaccgtttccccgtttccccg

SEQ ID NO: 307287 - DNA, 620 bp, Homo sapiens
  misc_feature: GZ8MTXP01C516X.44.37.D04.1.454.CMB.2.raw
  modified_base (200)..(200): a, c, t, g, unknown or other
  misc_feature (200)..(200): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcacctgtctttgtctccgagggganagacgccacctctcctggtacgggccagtcggagtgttgactaagtcctagcctaggtaaccaagagaaacctggaccaggccacccgaggcctcctcatctatgatgactactaccgaaacgtacgggtccaacgtcggacccaacccccgaaggtaccgtaggttcaggtcggaccgtagggtggggtctaggggactaagtacttcactcnccacggtnagactaaatcgtacagcctagaagttatttacgattaagtttactacgtgtcagtctacgggtcgttcctcgacggtcctacgtcgtacggtttcgggggacggggtaacctagggtggagaagtacgaggaccgttaagtgggtacgttcgcggacctaaccctagtcttagtccttctaaccgtttccctaacccg

SEQ ID NO: 307288 - DNA, 713 bp, Homo sapiens
  misc_feature: GZ8MTXP01EVCOJ.44.37.D04.1.454.CMB.2.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (406)..(406): a, c, t, g, unknown or other
  misc_feature (406)..(406): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagacgccaccctctcctggtacgggccagtcggagtgttgactaagtacctagcctggaccaanagaaacctggcaggcnccgaggctcctnatctatgatgacataccaaagtagggtccacgtcggacccaacccagactaggttcaggtcggcctaggtgggtcgtaggggaccaaagtccttcgaccttctccgaccggtnacgactaaagtcgtaacgacggtcctaggtaaacttagttttacggacttttaaaggttttacttacgttggttactacgtaccgtaacgggttccggtttccccgtaccggtaccgggtccccgtccgttacccggttaccgggttttacccggggggaccggggggtaacccgtaaagggggttacgggaacggtaacgtaccggaaacgggtaaccggttaaacggtcgggttcggggaccttcgggaccctaaccgtacgttccgttcggttccttacctaaccgtttccccgttaaccccgg

SEQ ID NO: 307289 - DNA, 675 bp, Homo sapiens
  misc_feature: GZ8MTXP01BL2GI.44.37.D04.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (437)..(437): a, c, t, g, unknown or other
  misc_feature (437)..(437): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgttctttgtctccgagggganagacgccaccctctccgtggtacgggccaggtcggagttgttgactaaagtacctagcctaggtaacccaaagagaaccgtggccaggccncccaggcctccnatctatgatcgcactaccaaacgagggtccacgtcggaccccaaccccgaagaccgtacggttcaggttcggacctaggggtcgggtacgtagggggacctaagtaccctttcaaccgttcaccgtaccgtnacggactaaatcgtacacgtctagtaagttagttttagactttaagtttattactgtacaacgtccgtaagggttcccgtttaccgtaccgacgggtcccgtaccttaccggtacgggtttccgggggacgggggtaacccgttaagggtcgggaagtaatacggaaggtacttaacggtggtcgacgttcggacctaaccgtattccgttcgttccttactccgttccgttaacccc

SEQ ID NO: 307290 - DNA, 652 bp, Homo sapiens
  misc_feature: GZ8MTXP01CSC4X.44.37.D04.1.454.CMB.2.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcacggagatattgtgttgacacagtctcaggcacctgtctttgctcgagggganagacgccacctctccgtggtacgggccaggtcggagtgtgactaagtacctagcctaggtaaccaaacagaaacctggaccaggcctaccaggcctcctnatctatgatgactataccaagagggtacacgtcggaccaccccgagacgtaggttcaggtcggacctagggtgggtacgnggggaaccaagtaccttcactctaccacgtnaagctaatcgtacaggtactaggtaattntttagactttaagtttactacgttgacaacgtcgtacgggtcctttccgacgtacggccgtctccggtacgggtttaccggggggacgggggtaacctaaaggggtcggaagaacgtaaccggaaggtaacgttaacggtaggttcgggccttcgggacctaacccggtttcttccggttcgtttaccttaccgttaacccgttcccgtaaccccg

SEQ ID NO: 307291 - DNA, 647 bp, Homo sapiens
  misc_feature: GZ8MTXP01A4KI2.44.37.D04.1.454.CMB.2.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (405)..(405): a, c, t, g, unknown or other
  misc_feature (405)..(405): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggganagagccaccctntcctgtagggccagtcggagtgttgctaagtacctagcctaggtaccaacagaaacctggccaggcnccaggctccnatctatgatgacactccaaagagggtcacgtggacccaccccgagacctaggttccaggtcggaccctagggtggggtctacggggacaagtaccttcaccgtctcacccgttanagacaatcgacacgtcgtagtaacgttatttacgtacttagtttactacgttcgtacgacgtcgtacgggtccgttccgtccgaccgggtccgtccgttaccgttaccggggtttaccgggggaccgggggtaaccgtaacggggtagggaacgtaacgtacggaaacggtaccgttacggtcggtacggcgttcgaccgtaactacttcgttacgttccttcgtaacccgttcccgtcccg

SEQ ID NO: 307292 - DNA, 691 bp, Homo sapiens
  misc_feature: GZ8MTXP01BKNW2.44.37.D04.1.454.CMB.2.raw
  modified_base (202)..(202): a, c, t, g, unknown or other
  misc_feature (202)..(202): n is a, c, g, or t
  modified_base (269)..(269): a, c, t, g, unknown or other
  misc_feature (269)..(269): n is a, c, g, or t
  modified_base (451)..(451): a, c, t, g, unknown or other
  misc_feature (451)..(451): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctccgtgtagggccaggtcggagtgttgctaagtacctagcctaggtaaccaaanagaaacctggaccaggcctcccgaggcctcctctatctagtgatgactactaccaaacgcgggtccacgtcggacccaaccccgaggacctagggttcaggttcggaccgtagggttcggggtacgtacgggggaacctaacgggtaacctttcgaaccttcccgtaccgaaccccggttanaacgtacgtaaacgttcggtaacacggtaccgtaggtaaacgttagtttttacgactttaagtttttactacgttcgtacaacgtcctacggggtccttccgtaccgacgggccctcgtccgtacggtttaccgggggacgggggtacctagggtcgggacgtaacgtacgaacggtacgttaacgtgggtacgttcgttcgacctaacgtgtcttacgtcttctaacttccgtaacccg

SEQ ID NO: 307293 - DNA, 778 bp, Homo sapiens
  misc_feature: GZ8MTXP01B0NT6.44.37.D04.1.454.CMB.2.raw
  modified_base (202)..(202): a, c, t, g, unknown or other
  misc_feature (202)..(202): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgaggggganagacgccaccctctccgtggtacgggccaggtcggagttgttgactaagtacctagcctaggtaaccaaanagaaacctggccaggccnccgagctcctacatctatgatgacactaccaagacgggtcacgtcggacccaacccgaggacggtaggttcgaaggtcggacccgtaggggttggggtcgtagggggaccaacgggttaccttccgaaccttccgtacctaacccggtcaacggactaaagttcggtaaccacggtacccgtagtaaagttagtttttacgactttaaggtttacttacgtcgtacgaacgtccgtacggttcccggtttacccgtacccggtacgggtccccgtaccgttacccggttaacccggggttttcccgggggggaacccggggggtaaacccgttaaagggggtacggggtaacggtaacggttacccggttaaaggggaaaccggttaaaccggtttaggggtacggggttccgttcggacccggtaacccttaggtttcccttccgggttccctttaccgtaacccgttttccccgtttaacccccg

SEQ ID NO: 307294 - DNA, 746 bp, Homo sapiens
  misc_feature: GZ8MTXP01AXKJ4.44.37.D04.1.454.CMB.2.raw
tcagacagtatatacacgaccggtgctcgatttagtagcatactgttgggtttggggagagaagacaggactcaggacgatctccagcatggccagcttccctctcctcctcaccctcctcactcactgtgcagggtcctgggcccagtctgtgatgtctcagccaccctcagcgtcgtcggggaccccccgggcgacgggggtccaccgatctcttgttctggaaggaagtccaatatcggatcttatcctgtcaactggtagtcgggactccgaggcaccggcccccgactccttatctatgactactatcacgccgccctcgacgggtccctcgccccgtattcctcgtcggcctaccgaagttccgtcggacctacgtaacgacggtccctaaacccgtcggccctacttccccttagaccttcccttaccccgaagttccgtagggtaacggtagttacgggaacgggtccttagggttaaactttacggtacgttcggtacgaccgtaaaggtccgtaaggtacggggggaagttacggaacccggacggggaacccgggtaacgggtccgggttagggggttcgggttccggggacggggtacggggaaacccgttaggttccggaacccggttccgtacgggttaccgaccggtaccccgaacgggttcccgttcccggtaaccccccgttggtaaccctaccgtcccgtttcccgtaacccccgttccctttccccg

SEQ ID NO: 307295 - DNA, 585 bp, Homo sapiens
  misc_feature: GZ8MTXP01AQE7V.44.37.D04.1.454.CMB.2.raw
  modified_base (252)..(252): a, c, t, g, unknown or other
  misc_feature (252)..(252): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (438)..(438): a, c, t, g, unknown or other
  misc_feature (438)..(438): n is a, c, g, or t
tcagacagtatatacacgaccggtgctcgatttagtagcatactgttgggtttggggggaagaggaagactgacggtcctcccaggagttcaggtgctgggcaccttgggcacggggggaggtgtgtcacaagatttgggctctgggcaccgtgggcatgggggaggcttagttcagcctggggggtccctgagactctcctgtgcagcctctggattcaccttcagtagctactggatgcacgtgggtccncaagctccgaggggaggggctggtgtgggtctcagtattaatagtgagtgggagtagcacaaagcctacggcggactccggtagaacgggccattcaccatcnccagagacccaacgcaaagaacncgactagtntctgacaaatgaaacngtctagagacgcgaggaccacggctgtatattacngtgacaagcggggcggtggcggggtcggttcggggagttgacgtattaccgtacttacgtacggtgtcggacgttcggtgggacccgaacggggtcaccggttccaccgtccgtcctcgactccttacccgaaccgaacgggtcccc

SEQ ID NO: 307296 - DNA, 678 bp, Homo sapiens
  misc_feature: GZ8MTXP01B7CIF.44.37.D04.1.454.CMB.2.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctcgaggggagagacgccaccctctccgtgtacgggccaggtcggagttgttgactaagtacctagcctaggtaaccaacagaaacctggaccaggcctccgagcctctcatctatgatgctactccaacgagggtcacgtcggacccaaccccgaggacgtaggttccaggtcggacctagggttgggtcgtgggacaagtaccttcacttcaccgaccgtcaagactaaatcgtaacgacgtccttaggaaacgttagttttacgacgttaagttttacttactcgtacagtccgttacggggtccgtttacccaccgacgggtccctccgttcggtaccgggtttccgggggacgggggtaacccgtaggggttcggaagttcgaacggttacggaaccgttaaggtcgggtcggttaccgttcggaccctaacgttcgttccgtttacggttcctttacctaaccgtttcccggttttcccccg

SEQ ID NO: 307297 - DNA, 705 bp, Homo sapiens
  misc_feature: GZ8MTXP01EG6HI.44.37.D04.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (392)..(392): a, c, t, g, unknown or other
  misc_feature (392)..(392): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccacctctcctgtacggccagtcggagtgttgctaagtacctagcctaggtaaccaanagaacctggccaggcncccaggctcctnatctatgatgcatccaacgagggtcacgtcgcccaacccgagactaggttcaggtcggcctaggtgggtcgtgggacaacgtacttcacttcacaccgtnacggtcaaatcgtacacgtaccgtagtaaacgttatttttaggactttaagttttacttaacgttcgttacaacgtccgttaacggggttacccgttttcccgtacccgtaacggggtccccgttaccgttaccggttaacccggggttttaccggggggacccggggggtaaaccctaaagggggttacggaacggtaaacgttcccggaaacggggtaaacccgttaaaggttcgggttcgggacccgttcggacccgtaaccttagttccgtcggttacctttaccgtaacctttccccgtttaaccccg

SEQ ID NO: 307298 - DNA, 718 bp, Homo sapiens
  misc_feature: GZ8MTXP01D1C32.44.37.D04.1.454.CMB.2.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccacctctcctgtacgggccaggtcggattgttgacttaaagtacctagcctaggtaaccaaacgagaaacctggccaggcctaccccgaggcctcctacattctatgatgacataccaacgaggtcacgtcggacccaccccgagactaggttacaggtcgccgtagggtcgggtaccgtggggacaacgtacctttcgaccttcctaccgaccgtacaaggtactaaacgtcgtaacaggtaccttaggtaaagttagtttttacggactttaaacgtttttataacgttcggttacaacggtccttaacggggttccccgttttacccgtacccgaccgggttccccgtacccgttccgttaaccggggtttccggggggaaccggggggtaaacctaaggggttacgggacggtaactaccggaaggtaaaccggttaagtcgggttacggcgttcggaccctaacctagttcgttacgtctttccctaactttccccgtaaccccg

SEQ ID NO: 307299 - DNA, 553 bp, Homo sapiens
  misc_feature: GZ8MTXP01BWHZ4.44.37.D04.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (312)..(312): a, c, t, g, unknown or other
  misc_feature (312)..(312): n is a, c, g, or t
  modified_base (443)..(443): a, c, t, g, unknown or other
  misc_feature (443)..(443): n is a, c, g, or t
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctntcctgtagggccagtcggagtgttgctaagtacctagcctggtaccaacagaaacctggcaggctcccaggcctcctcatctatgatgcatcccaaanagggtcactggcaccccagacaggttcagtgccagtgggtctgggacaaggacttcgactcgtccaccgtcagctaaatgtacagcctagacgtatttgctagtttatactgtcatcaggcgttcctaccnggtaccgctcgaccgtttcgggccggggggtaaccagggtgggagaagtcnggaacgacgtggtcgggcttcggacnccgatcgttgtcccttgtaacttcccgttcccg

SEQ ID NO: 307300 - DNA, 770 bp, Homo sapiens
  misc_feature: GZ8MTXP01DSM9E.44.37.D04.1.454.CMB.2.raw
  modified_base (561)..(561): a, c, t, g, unknown or other
  misc_feature (561)..(561): n is a, c, g, or t
tcagacagtatatacacgaccggtgctcgatttagtagcatactgttgggtttgggggaggaactgctcagttaggacccagagggaaccatggaagcccagctcagcttctcttcctcctgctactctggctcccagagatcaccggagatattgtgttgacacagtctccgaggcaccctgttctttgctccgaggggagagacgccaccctctccgtggtacgggccaggtcggagttgttcgacctaaagtacctagccgtaggtaacccaaacgacgaaaccgtcgggacccaggccctaccccgaggtccctcccgtactaacttccttaagtgtactcggacctaacttacccgaaacgtacggggtacaccgtcggacccaaaccccgagacgtaggttccgaggttcgggacccgtagggttcgggtagtacggggaacctaacgtaacctttccgaacttccgtacccaccgtacgaacggctaaatcggtaactacgtcggtaataagtttacgttttgactttaaggttttacttacgcgggttaaccncgtacgtaccggggttcccgtttcccggaccgtaccggtccgtacccgttacgggttacccgggggttaccggggggacgggtaacgtaggggtacggtaacgtaactcgggaaacgggtacggttacggtcgggtacggttaccgttcgaaccccgtaactttcggtttccttacgttacccgttactccccgtttccccgtaacccg

SEQ ID NO: 307301 - DNA, 644 bp, Homo sapiens
  misc_feature: GZ8MTXP01BTXIP.44.37.D04.1.454.CMB.2.raw
  modified_base (276)..(276): a, c, t, g, unknown or other
  misc_feature (276)..(276): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (590)..(590): a, c, t, g, unknown or other
  misc_feature (590)..(590): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacccttgttctttgtctccgaggggagagacgcccacccttctcctggtacgggccaggtcggagttgttgactaagtaccctagcctaggtaaccaanagaaacctggccaggctcccgaggcctcctcatctatgatgctactccaagngggtcacgtggacccacccagactaggttcaggtggaccnggtgggtcgtcggggacaaggttaccttcactcctaccgacctacgagctaaagtcgtacacggtccctaggtaacgttattttacgacgtttaagttttacttactggttaccagtactacgggtcgtttcccgtaccgaccggtcccgtcgttccgtaccggtttccgggggaccggggtaaccgagggttggacgaagtacgaggtaccgaaggttcgnggttccgcggttaccaacgtacttcggtacttccttacgtcttcccgttccccg

SEQ ID NO: 307302 - DNA, 522 bp, Homo sapiens
  misc_feature: GZ8MTXP02IVK59.44.37.D04.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (375)..(375): a, c, t, g, unknown or other
  misc_feature (375)..(375): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggctcccaggctcctcatctatgatgcatccaaanagggtcactggccaccccagacaggttcagtgccagtggtctgggacagacttcactctcaccgtnagcaaatgtacagcctagaagtattttgctagtttattactgtcagcagcgttctccaggccgctcacgtttcgggcgggggaccaagggtggagatcgaggacgaaacgtgtcggctgcaaccgatctcgtcttcactccttcccg

SEQ ID NO: 307303 - DNA, 517 bp, Homo sapiens
  misc_feature: GZ8MTXP02I0X3Q.44.37.D04.1.454.CMB.2.raw
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (348)..(348): a, c, t, g, unknown or other
  misc_feature (348)..(348): n is a, c, g, or t
  modified_base (434)..(434): a, c, t, g, unknown or other
  misc_feature (434)..(434): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctccagagatcaccggagatattgtgttgacacagtctccaggcaccctgtcttttgtctccgaggggagagagccaccctctcctgtagggccagtcggagtgttgctaagtacctagcctggtaccaanagaaacctggccaggctccaggctcctnatctatgatgcatccaaanaggtcactggcacccagacaggttcagtgccagtggtcngggacagacttcactctcaccgtcagcaaatgtacagcctgaagtatttgctagtttatactgtcagtcagcgttctccaggcccnctcacgtttcgggacgggggtaccaagggtgagtactcgagacgaaacgtgtggctgacaaccgatctgtctcactcttcccg

SEQ ID NO: 307304 - DNA, 531 bp, Homo sapiens
  misc_feature: GZ8MTXP02HS2RC.44.37.D04.1.454.CMB.2.raw
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaaccaanagaaacctggccaggctcccaggctcctcatctatgatgcatccaaacgnggtcactggcaccccagacaggttcagtggccagtgggtctggggacagcttcactctcaccgtnagctaatgtacngctagaagtnttttgctagtttatactgtctagcagtcgttcctccgaggcccgctctacgtttcgggcgggggtaccaagggtgaacgtagtcgaggacgaacgtgtcggctgcaacgatctcgtcttcatttcctcccg

SEQ ID NO: 307305 - DNA, 750 bp, Homo sapiens
  misc_feature: GZ8MTXP02JWMN9.44.37.D04.1.454.CMB.2.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctggtagggccagtcggagtgttgactaagtacctagcctaggtaccaacagaacctggccaggcctccgaggctcctcatctatgatgcactacccgaagngggtccacgtcggacccaccccgagaccgtaggttcagggtcggaccgtagggttcgggtcgtacggggactacgtacttccgaccttccgtaccaccgtcacgtactaacgttacgtaccgtacggtacccgttaaggtaaacgtttcgtttttacggtaccttttaaggtttttaacgttaccgttacggtaccgtacggttcccgtaccgggtttccccgtttaccccggtacccgggtaccggggttcccccgtaccgtttacccggggttacccgggggtttaccggggggaacccgggggtaaccggtaagggggtacggaaacgtaccggtaacggacgggtaaccggtacggtcggtaccgggtcctacgacccttaacgtactttccgtcgttacccttcttacccgttcccgttaccccg

SEQ ID NO: 307306 - DNA, 521 bp, Homo sapiens
  misc_feature: GZ8MTXP02GL8IT.44.37.D04.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctggtagggccaggtcggagtgttgctaagtcctagcctggtaccaanagaaacctggccaggctcccaggcctcctnatctatgatgcatccaanagggtcactggccaccccagacaggttcagtggccaggtgggtctggggacagacttcactctcaccgtnagcaaatgtacagcctagaagtattttgctagttttatactgtcagcagtcgttccncaggccnctcacgttcgggcgggggaccagggtgagactcgagacgaacgtgcgctgcaacgatctcgtctcactccttcccg

SEQ ID NO: 307307 - DNA, 520 bp, Homo sapiens
  misc_feature: GZ8MTXP02FSNCD.44.37.D04.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (375)..(375): a, c, t, g, unknown or other
  misc_feature (375)..(375): n is a, c, g, or t
  modified_base (438)..(438): a, c, t, g, unknown or other
  misc_feature (438)..(438): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtcctagcctggtaccaanagaaacctggccaggctcccaggctcctcatctatgatgcatccaacagggtcactggccaccccagacaggttcagtgccagtgggtctgggacagacttcactctcaccgtnagcaatgtacagctagaagtattttgctagtttatactgtcagcagtcgttcctccaggtccnctcgacgtttcgggcgggggtaccaagggtcggagacgtcagacgaactgtcggctgcaacgatctgtcttcactcttcccg

SEQ ID NO: 307308 - DNA, 533 bp, Homo sapiens
  misc_feature: GZ8MTXP02JYND8.44.37.D04.1.454.CMB.2.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtcctagcctggtaccaacagaaacctggccaggctcccaggctcctcatctatgatgcatccaacagggtcactggcaccccagacaggttcagtggccagtgggtctggggacagacttcactctcaccgtcagcaatgtacagcctgaagtatttgctagtttattactgtacagcagtccgttcctccgacgggccgctcgtacgtttcggggcgggggaccaagggtggagacgtcgagacgaacgtgtcggctgaccaacgatctcgttctctacttccttcccg

SEQ ID NO: 307309 - DNA, 566 bp, Homo sapiens
  misc_feature: GZ8MTXP02F81NJ.44.37.D04.1.454.CMB.2.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagagccaccctctcctgtagggccagtcggagtgttgactaagtacctagcctggtaaccaacagaaacctggccaggcctccaggcctcctcatctatgatgcatccaaacgagggtcacgtcggacccaccccgaggacctaggttcaggtggccgaggtcggggtctggggacagacttcactctacaccgtcagcaaatcgtacacgctagaagttattttgacttagtttatactgtcagcagtccgttcctcgacggccactccgtacggtttcggggacgggggaccgtaagggtcggagtactacgagaacgtaacgtggcgctcgacaaccgtagtctcgtcttacactcctcccg

SEQ ID NO: 307310 - DNA, 543 bp, Homo sapiens
  misc_feature: GZ8MTXP02I8IYJ.44.37.D04.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtcctagcctggtaccaanagaaacctggccaggctcccaggcctcctcatctatgatgcatccaacngggtcacgtggccaccccagacaggttcaggtggccagtgggtctgggacagacttcactctacaccgtnagcaatgtacagcctagaagtntttgctagtttatactgtcagcagtcgttcctccgaggtcccgctccgtacgtttcggggacgggggtaccaggggtcgagacgtcgaggacgtaacgtggtcggactcgacaacgtatcttcgtctctacttcccttcccg

SEQ ID NO: 307311 - DNA, 556 bp, Homo sapiens
  misc_feature: GZ8MTXP02JU75T.44.37.D04.1.454.CMB.2.raw
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagcccaccctctcctgtagggccagtcggagtgttgctaagtcctagcctggtaccaanagaaacctggccaggctcccaggctcctcatctatgatgcatccaanagggtcacgtggcaccccagacaggttcagtggccaggtgggtctggggacagacttcactctccaccgtnagcaatgtacagcctagaagtatttgctagtttactatgtcagcagtcgttcctccgacgggtccgcttccgtacggtttcggggacgggggaccgtaagggtggaacgacgtcgaggacgtaacgtggtacggctcggccaaccgattcgtcgtccttctacgttccttaccccg

SEQ ID NO: 307312 - DNA, 576 bp, Homo sapiens
  misc_feature: GZ8MTXP02FRK3P.44.37.D04.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (376)..(376): a, c, t, g, unknown or other
  misc_feature (376)..(376): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggctcccaggcctcctcatctangatgcatccaacnggtcacgtggccaccccagacaggtcaggtgccagtggtctgggacagacttcactctcaccgtnagcaatgtacagcctagaagttatttgacttagtttattactgtacagcacgtccgttcctccgtacgggccctccgttcgtaccggtttccgggggaccgggggaacctaaggggtcggaagtacgtacgaaggtaccgtaaagtcggtcgggtactcggaccaaccgtactcgttcgtccttactacctccttccccg

SEQ ID NO: 307313 - DNA, 532 bp, Homo sapiens
  misc_feature: GZ8MTXP02HTSZW.44.37.D04.1.454.CMB.2.raw
  modified_base (328)..(328): a, c, t, g, unknown or other
  misc_feature (328)..(328): n is a, c, g, or t
  modified_base (374)..(374): a, c, t, g, unknown or other
  misc_feature (374)..(374): n is a, c, g, or t
  modified_base (442)..(442): a, c, t, g, unknown or other
  misc_feature (442)..(442): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggcttccagagatcaccggagatattgtgttgacacagtctccaggcacccctgtctttgtctccaggggagagagccaccctctcctgtagggccagtcggagtgttgctaagtcctagcctggaccaacagaaacctggccaggctcccaggctcctcatctatgatgcatccaacaggtcactggcaccccagacnggttcagtggccagtgggtctgggacaggacttcactctcaccgtnagcaatgtacagcctagaagtatttttgcttagtttattactgtcagcagtcgtttcctccaggcccncgtcgtacgtttcgggcgggggaccagggtggagacgtcgagacgaactggtacggctcgcaaccgatcgtgtccttcacgttcctcccg

SEQ ID NO: 307314 - DNA, 539 bp, Homo sapiens
  misc_feature: GZ8MTXP02IZUOS.44.37.D04.1.454.CMB.2.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccacctctcctgtagggccagtcggagtgttgctaagtacctagcctggtaccaanagaaacctggccaggctcccaggctcctcatctatgatgcatccaacaggtcactggccacccagacaggttcagtggccagtgggtctggggacagacttcgactctcacccgtnagcaatgtacagcctgaatntttgctagtttattactgtcagcagtcgttccnccaggccnctcacgttcgggcgggggtacaagggtggatacgtcgaaagacgtaaacgtggtacggctcggacaacctacgtcttcggtctttcacgtttccttaccccg

SEQ ID NO: 307315 - DNA, 549 bp, Homo sapiens
  misc_feature: GZ8MTXP02IV9KB.44.37.D04.1.454.CMB.2.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtcttttgtctccagggganagagccacctctcctgtagggccagtcggagtgttgctaagtcctagcctggtaccaacagaaacctggccaggctcccaggctcctcatctatgatgcatccaacagggtcacgtcggccaccccagacaggttcagtggccagtggtctgggacagcttcactctcaccgtcagcaaatgtacagcctagaagtattttgctagtttattactgtcagcagtccgttcctccgagggcccgtctcgtacggtttcggggacgggggaccgaagggtcggaagtactcgaagacgaaacgttggacggctggcaaccgtatcgtcgtctttacacttcctttcccg

SEQ ID NO: 307316 - DNA, 516 bp, Homo sapiens
  misc_feature: GZ8MTXP02GIAT9.44.37.D04.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (367)..(367): a, c, t, g, unknown or other
  misc_feature (367)..(367): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtcctagcctggaccaanagaaacctggccaggctcccaggctcctcatctatgatgcatccaacagggtcactggccacccagacaggttcagtggccagtggtctggggacagacttcactcncaccgtcagcaaatgtacagcctgaagtatttgctagtttattactgtcagcagccgttccccaggccgctcacgttcgggcgggggacaaggtgagagtacgagacgaactggcggcgtcgcacgaatctcgtctctactcctccgtc

SEQ ID NO: 307317 - DNA, 536 bp, Homo sapiens
  misc_feature: GZ8MTXP02F5W5X.44.37.D04.1.454.CMB.2.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccacctctcctgtagggccagtcggagtgttgctaagtcctagcctggtaccaanagaaacctggccaggctcccaggctcctnatctatgatgcatccaanggtcactggcacccagacaggtcagtgccagtgggctgggacagacttcactctacaccgtnagcaatgtacagcctagaatntttgctagtttatactgtcagctagtccgttcctcacggcccgtctcgtacgtttcggggcgggggtaccagggtggagtactacgagacgaacgtggtacgctcggacctaacgtactcgttcgtccttctacttccgtttccccg

SEQ ID NO: 307318 - DNA, 560 bp, Homo sapiens
  misc_feature: GZ8MTXP02JFFS7.44.37.D04.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (386)..(386): a, c, t, g, unknown or other
  misc_feature (386)..(386): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (535)..(535): a, c, t, g, unknown or other
  misc_feature (535)..(535): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtagggccaggtcggagtgttgctaagtacctagcctggtaaccaanagaaacctggccaggctccaggctcctcatctatgatgcatccaaanagggtcacgtcggccaccccagacaggttccagtggccaggtgggtctgggacagacttcactctcaccgtnagcaatcgtacagcctagaagtattttgactagtttattactgtacagctagtccgtttaccncgacgggcccncgtcgtacgtttcgggggacgggggacctaagggtggacgtactacgaggaacgacgtggtacggctgcaaccgngtctgtcctacgtacttcctacccg

SEQ ID NO: 307319 - DNA, 510 bp, Homo sapiens
  misc_feature: GZ8MTXP02HOGIL.44.37.D04.1.454.CMB.2.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (421)..(422): a, c, t, g, unknown or other
  misc_feature (421)..(422): n is a, c, g, or t
  modified_base (439)..(439): a, c, t, g, unknown or other
  misc_feature (439)..(439): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctggccaggctcccaggctcctcatctatgatgcatccaaacaggtcactggcaccccagacaggttcagtgccagtggtcgtggacgacgactcactctcaccgtacagacatatacanctagaagtaatttgtntatttattattatananncgtcgtctcgacgcgcnctcgtcgggcgggacggagagagacgagagacgacgtagtcgcgcacaacactactctctactactctccg

SEQ ID NO: 307320 - DNA, 566 bp, Homo sapiens
  misc_feature: GZ8MTXP02HPH7F.44.37.D04.1.454.CMB.2.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (379)..(379): a, c, t, g, unknown or other
  misc_feature (379)..(379): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtaggccagtcggagtgttgctaagtcctagcctggaccaanagaacctggccaggctcccaggctcctnatctatgatgcatccaacgagggtcacgtggccaccccagacaggttcaggtggccaggtgggtctggggacagacttcacttctcaccgtnagcaatgtacacgctagaagtatttgcttagtttattactgtcagctacgtcgtttcctccgacggtccgtccgtcgtacggtttccggggacggggggacctaaggggtcggaaggtactacggaggaacgtaacgttggtcggcgtcggcctaaccgtagtcttcgtcttctacttccttccccg

SEQ ID NO: 307321 - DNA, 575 bp, Homo sapiens
  misc_feature: GZ8MTXP02GTXTR.44.37.D04.1.454.CMB.2.raw
  modified_base (291)..(291): a, c, t, g, unknown or other
  misc_feature (291)..(291): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagagccaccctctcctgtagggccagtcggagtgttgctaagtacctagcctggtaccaacagaaacctggccaggctcccaggctccncatctatgatgcataccaagaggtccaacgtggacccaccccagactagggttccaaggtggacccgtaggtcggggtctggggaacaggtacctttcgaactctacgacccgtcaagcaaatgtaacacgtcctagaagtatttgactagtttattactgtacagcagtcgttacctcgacgggcctctccgtaccggttcgggacgggggtaccaggggtgagactcgagaacgaacgtggtcggctcgacaacgacgtctcgtcttcaccttcctaccccg

SEQ ID NO: 307322 - DNA, 586 bp, Homo sapiens
  misc_feature: GZ8MTXP02IHY1V.44.37.D04.1.454.CMB.2.raw
  modified_base (201)..(201): a, c, t, g, unknown or other
  misc_feature (201)..(201): n is a, c, g, or t
  modified_base (320)..(320): a, c, t, g, unknown or other
  misc_feature (320)..(320): n is a, c, g, or t
  modified_base (397)..(397): a, c, t, g, unknown or other
  misc_feature (397)..(397): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagacgccaccctctcctggtacgggccaggtcggagtgttgctaagtacctagcctggtaccaacagaaacctggccaggcctacccgaggcctcctcatctatgatgcatacccaagngggtcacgtcggacccaccccgagactaggttcaggtcggcaggtgggtctggggacagacttcactctccaccgtnagctaatcgtacagtactagtagttatttgacttaagtttactactgtacagtctacgtcgttccgcgacggccgtcgtacgtacgggttccggggacggggacgtagggtgaacgtacgtacgaaggacgtacggtcggtcgtcgtcgaccaacgtacgttcgtcgttcctacctacttcccgtcccg

SEQ ID NO: 307323 - DNA, 567 bp, Homo sapiens
  misc_feature: GZ8MTXP02IU91L.44.37.D04.1.454.CMB.2.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
tcagacagtatatacacgaccggtgctcgatttagtagcatactgttgggtttggggaggaactgctcagttaggacccagacggaaccatggaagccccagcgcagcttctcttcctcctgctactctggctcccagagatcaccggagatattgtgttgacacagtctccaggcaccctgtctttgtctccgagggganagagccacctctcctgtacgggccagtcggagttgttgctaagtcctagcctggtaccaacagaaacctggccaggctccaggctctcatctatgatgcatccaacgagggtcacgtggacccaccccgagacctagggttcaggtggaccaggtggtctgggacagacttcgactcncaccgtcagcaatgtacagctagagtatttgacttagtttatactgtcagactacgtcgttcctccgacggcccgtctcgtacggtttcggggacgggggtaccgtaagggtcggaacgtacgtcgaaaggacgtaaacgtggtacggcgtcgactaacgacgtcgtcgtccttctacttccttcccg

SEQ ID NO: 307324 - DNA, 583 bp, Homo sapiens
  misc_feature: GZ8MTXP02J2LXO.44.37.D04.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccagggganagagcccacctctcctggtagggccagtcggagtgttgctaagtcctagcctggtaccaanagaaacctggccaggctccaggctcncatctatgatgcatccaanaggtcacgtcggaccaccccagacaggttcaggtggcctaggtggggtctggggacaggtcttcactctccaccgtnaagcaatcgtaacngcctagaagtatttggctagtttacttactgtcagctagtccgttcctcgacgggtcccgcgtaccgtacggtttccgggggcgggggtaaccaaggggtacggaggtacgtacgaaggaaccgtaacgttggtacggacgtcgaccaacccgtattccgtcgttccttacgactttccttccccg

SEQ ID NO: 307325 - DNA, 533 bp, Homo sapiens
  misc_feature: GZ8MTXP02HX42C.44.37.D04.1.454.CMB.2.raw
  modified_base (199)..(199): a, c, t, g, unknown or other
  misc_feature (199)..(199): n is a, c, g, or t
tcagacagtatatacacgaccggtgctcgatttagtagcatactgttgggttggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccaggtcggagtgttgctaaagtacctagcctggtaccaacagaaacctggccaggctcccaggctcctcatctatgatgcatccaaacaggtcactggcaccccagacaggttcagtggccagtgggtctggggacagacttcactctcaccgtcagcaatgtacagcctgaagtattttagctagtttattactgtacagtcagcgtttcctccaggccgcgtccacgtttcggcgggggtaccaagggtaggagtagacgagacgaacgtgtacgcgtgacaaccgatctcgtcttacacttcctcccg

SEQ ID NO: 307326 - DNA, 822 bp, Homo sapiens
  misc_feature: GZ8MTXP02GNZ9U.44.37.D04.1.454.CMB.2.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtacctagcctggtaccaacagaaacctggccaggcctccaggcctcctcatctatgatgcatacccaaacgacgggtcacgtcggacccaacccccaggacctagggtttccaaggttcgggaccctagggttcggggtacgtacgggggaacctaggactttccgaaccttccttaccgaacccggtcaacggtacctaaaagttcgtaaaccgacggtacccgtaaggtaaaacggttaagttttttacggaccgtttaaaggttttttaactttaaccgttacggttaccgtaaacggtcccggttaaacgggttccccggttttaccccgttaccccggtaaccgggggttacccccgtcccgtttacccggttacccggggtttttaccccgggggggacccggggggggttaaacccgttaaacggggggtacggggtaaacggtaacggttaccggaaaacgggtaacccgggttaaaaccggttgggtaccggggaccttcgggaaccctaacccggtacgtttaccgtttacgttcccgtttaccgttacctttaccccgtttcccccg

SEQ ID NO: 307327 - DNA, 557 bp, Homo sapiens
  misc_feature: GZ8MTXP02IXY3B.44.37.D04.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctgtagggccagtcggagtgttgctaagtacctagcctggtaccaanagaaacctggccaggctccaggctcctnatctatgatgcatccaaagagggtcacgtcggaccaccccagacaggttcaggtggccaggtgggtcnggggacagcttcactcncaccgtnagcaaatgtacagcctagaagtatttgactagtttattactgtcagtctagtcgttcctaccgaggccgtctccgtacgtttcggggcgggggtaccgagggtggacgtagtacgaacggtacgaacgtggtcgcgtcgacaaccgtatccgttgtcttcactttccgttcccg

SEQ ID NO: 307328 - DNA, 536 bp, Homo sapiens
  misc_feature: GZ8MTXP02JZV27.44.37.D04.1.454.CMB.2.raw
  modified_base (200)..(200): a, c, t, g, unknown or other
  misc_feature (200)..(200): n is a, c, g, or t
  modified_base (375)..(375): a, c, t, g, unknown or other
  misc_feature (375)..(375): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccaccctctcctgtagggccagtcggagtgttgctaagtcctagcctggtaccaacagaaacctggccaggctcccaggctcctcatctatgatgcatccaacagggtcactggcaccccagacagttcagtggccagtgggtctggggacagacttcactctcaccgtnagcaatgtacagcctagaagtatttgctagtttattactgtcagcagtcgttcctccgacggccgctcacgtttcgggcgggggacctaagggtcggagacgtcgaggacgaaacgtggtacgcgtgaccgtaacgatcgtcgtcttctactccttccccg

SEQ ID NO: 307329 - DNA, 605 bp, Homo sapiens
  misc_feature: GZ8MTXP02HM7ZQ.44.37.D04.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
  modified_base (398)..(398): a, c, t, g, unknown or other
  misc_feature (398)..(398): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtcctagcctggtaccaanagaacctggccaggctcccgaggctctcatctatgatgcatccaacgnggtcacgtcggacccaccccgagactaggttcaggttggaccagggtcggggtcgtaggggacaggtaccttcacgttctccaccgtnacgactaagtcgtacacgacctagaagttattttggacttagtttatacgttgtcagtctacggtccgtttccgtccgacgggtcccgtccgtccgtaccgggtttcgggggaccgggggaacctaggggtggaacgtacgtacgacggaacgtaacgtcggtacggctacgactaaccgatcgtcgttctcctacttcccgtcccg

SEQ ID NO: 307330 - DNA, 540 bp, Homo sapiens
  misc_feature: GZ8MTXP02HTMXA.44.37.D04.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (377)..(377): a, c, t, g, unknown or other
  misc_feature (377)..(377): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtcctagcctggtaaccaacagaacctggccaggctccaggctcctnatctatgatgcatccaagaggtcacgtggccacccagacaggttcagtggccaggtgggtctggggacagacttcactctcaccgtnagcaatgtacagctagatattttgacttagtttatactgtcagcagcgtttccncgaggccnctcgtacggttcggggacgggggacgagggtgagtacgtcgaggaacgtacgtggacggtctgaccgtaacgtactcgttcgtcctctactttccgtcccg

SEQ ID NO: 307331 - DNA, 678 bp, Homo sapiens
  misc_feature: GZ8MTXP02GDMLR.44.37.D04.1.454.CMB.2.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccgagggganagacgcccaccctctcctggtacgggccaggtcggagtgttgctaagtcctagcctggtaccaanagaacctggccaggctcccaggcctccncatctatgatgcatcccaacgngggccctagtcggcctccctgactaggttcaggtcggccgtagggtcggggtctaggggactaggtacttcacttctaccaccatcagccagcccgtaggacgccgtaggtaaacgttattttggtagtaagttgttaactttacgttagttaccttacttttacctacgtttccggtttaccccctttaaccgttaccggtttaaacgtttttcgggacccggtaaacgggggtaaaccctaaaacggttacgggtaaaactaaccgtaaaaaccggtacgttaggtaacgggtccttacgacctaaccttagtccgttacgttaccttacctacgtttcccttaccccgtacttaacg

SEQ ID NO: 307332 - DNA, 577 bp, Homo sapiens
  misc_feature: GZ8MTXP02FJHDF.44.37.D04.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtacccaanagaaactggccaggctcccaggctcctcatctatgatgcatccaacgnggtcacgtcggaccaccccagacaggtcaggtggccaggtgggtctgggacagacttcactctcaccgtcagcaaatgtacagcctagaagtattttgcttagtttatactgtcagcagtccgttcctccgacgggcccgcgttcgtaccgtttcgggggaccgggggtaccaaggggtgggaagactaccgaaggaaccgaaacgttcgggcggtactggaccaaccgacttcgttcgttacttaccgtacttcccgttaccccg

SEQ ID NO: 307333 - DNA, 542 bp, Homo sapiens
  misc_feature: GZ8MTXP02IP6LK.44.37.D04.1.454.CMB.2.raw
  modified_base (202)..(202): a, c, t, g, unknown or other
  misc_feature (202)..(202): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (434)..(434): a, c, t, g, unknown or other
  misc_feature (434)..(434): n is a, c, g, or t
  modified_base (518)..(518): a, c, t, g, unknown or other
  misc_feature (518)..(518): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccacctctcctgtacggccagtcggagtgttgctaagtacctagcctggtaccaacagaaacctggccaggctccaggctcctcatctatgatgcatccaacaggtcactcggccaccccagaccaggttcagtgccagtggtctgggacngactcactcncaccgtcagcaatgtacagcctagaagtnttttgcttagtttactactgtcagctagtccgtttccnccgaggccccgtctcgtaccggtttcggggacgggggactaagggtggatacgtacgaggaacgtagtcggtcgctgacgaacntcttcgtcttcgacttccgtcccg

SEQ ID NO: 307334 - DNA, 681 bp, Homo sapiens
  misc_feature: GZ8MTXP02GIWSG.44.37.D04.1.454.CMB.2.raw
  modified_base (302)..(302): a, c, t, g, unknown or other
  misc_feature (302)..(302): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagacgccaccctctcctggtacgggccaggtcggagtgttgctaagtacctagcctaggtaaccaacacgaaacctggccaggcctcccgaggcctcctnatctatgatgcactaccaacgagggtccacgtcggacccaccccgagacgtaggttcaggtggccgtaggtgggtcgtaggggactaggtaccttcacctctaccgaccgtcagacctaaatcgtaacacgtcctaagtaagttacttttcgactttaagttttaattacgtagtactagtcgtaacgtccgtttcccgaccgtacgggtcccgtccgttaccgtaccgggtttccgggggaccgggggtaaaccgtaaggggtacggaacgtacgtacggaaacggtaaccggtaaaccggttggtaccggtacgtaccggaccctaaaccgtcgttccgttcggttacccttctaacccgtttcccgtttacccccg

SEQ ID NO: 307335 - DNA, 629 bp, Homo sapiens
  misc_feature: GZ8MTXP02GNXMR.44.37.D04.1.454.CMB.2.raw
  modified_base (392)..(392): a, c, t, g, unknown or other
  misc_feature (392)..(392): n is a, c, g, or t
  modified_base (510)..(510): a, c, t, g, unknown or other
  misc_feature (510)..(510): n is a, c, g, or t
  modified_base (556)..(556): a, c, t, g, unknown or other
  misc_feature (556)..(556): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtagttgacacagtctccaggcaccctgtctttgtctccaggggagagagccaccctctcctgtacgggccagtcggagttgtgactaagtacctagcctaggtaccaacacgaaaccgtcggaccaggcctacccgaggtcctcctacatctatgatcgactactacccgaaacgaggtccacgtcggacccaccccgagacctaggttcaggttcggccgtagggtgggtacgnggggaactaggtactttccactcctaccgaccgtcaagacctaagtacgtaccacgccttaagaacgttagttttgactttagtttacgttactgtacagtctacgttccgttacccncgacgggcctccgtacgtacggttcgggggacggggactaaggggngtacgactacgagaacgtagtcggtcgacgtacgacctaacgtacttcgtcgttactacgtacgtcccgtccg

SEQ ID NO: 307336 - DNA, 520 bp, Homo sapiens
  misc_feature: GZ8MTXP02F3Z0R.44.37.D04.1.454.CMB.2.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
  modified_base (425)..(426): a, c, t, g, unknown or other
  misc_feature (425)..(426): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctgacgggccagtcggagtgttgctaaagtacctagcctggtaccaacagaaacctggccaggctcccagctcctcatctatgatgcaatccaanagggtcacgtcggcaccccagacaggttcagtgccaggtggtctggacagacttcgacnctcaccgtnagcaatgtacagctagaagtattttgctagtttaatacngtcannagcgtctctacgcgcnctacgtcggtcggggacggacggtaggagacgtanagacgaacgacgtcggcgcgacaacactctctctctctctccg

SEQ ID NO: 307337 - DNA, 678 bp, Homo sapiens
  misc_feature: GZ8MTXP02F0UQA.44.37.D04.1.454.CMB.2.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (403)..(403): a, c, t, g, unknown or other
  misc_feature (403)..(403): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatatttgtgttgacacagtctccaggcaccctgtctttgtctccgagggganagacgcccaccctctcctggtagggccaggtcggagtgttgctaagtacctagcctggtaccaanagaaacctggccaggctccgaggcctcctcatctatgatgacactaccaacgagggtccacgtcggacccaccccgagaccgtaggttcaggtggccagggtgggtctgggacagtacttcactctaccaccgtnacgactaatcgtacacgtacgtagtaagttattttagacgtttaagtttaacttacgtagtactacgtcgtacgtcccgttccgtaccggaccgggtcccgtaccgttaccggttaccggggtttccgggggaaccgggggtaaccggtaacgggggtacggaacggtaacgtacggaaacggtaaccggtaaacggttcgggtacggtaccgtacggaccctaaccgtacgttaccgtttcgttaccgttaccgttaccgttacccgttccccg

SEQ ID NO: 307338 - DNA, 626 bp, Homo sapiens
  misc_feature: GZ8MTXP02GK93F.44.37.D04.1.454.CMB.2.raw
  modified_base (202)..(202): a, c, t, g, unknown or other
  misc_feature (202)..(202): n is a, c, g, or t
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtacgggccaggtcggagtgttgactaagtacctagcctggtaaccaanagaaacctggccaggctccaggcctccnatctatgatgcatccaacgagggtccacgtcggccaaccccgagacaggttcaggtggacccaggtcggtcgtaggggacaggtacttcactctcgaccgtnacgacaatcgtacacgcgtagaagtntttagacttaagtttacttacgtagtcgaagtctacggtccgtttacccgccgtaccgggccgtccttaccgtaccggtttccgggggaccgggggtaccgtaaggggtacggaggtacgtaccgaaggtaccgtaaacgtggtccgcgtcggacctaacccgagttccgttcgttacctacgtactttcccgtttccccg

SEQ ID NO: 307339 - DNA, 517 bp, Homo sapiens
  misc_feature: GZ8MTXP02FM2FN.44.37.D04.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtggtgctaagtacctagcctggtaccaanagaaacctggccaggctcccaggctcctcatctatgatgcatccaacagggtcactggcaccccagacaggttcagtggccagtgggtctggggacagacttcactctcaccgtcagcaaatgtacagcctgaagtattttgctagtttaattactgtcagcagcgttcctccaggccgctcacgtttcgggcgggggacagggtgagactcgagacgaactgtcggctgcaacatctcgtctcactcttccccg

SEQ ID NO: 307340 - DNA, 649 bp, Homo sapiens
  misc_feature: GZ8MTXP02JDIZQ.44.37.D04.1.454.CMB.2.raw
  modified_base (201)..(201): a, c, t, g, unknown or other
  misc_feature (201)..(201): n is a, c, g, or t
  modified_base (486)..(486): a, c, t, g, unknown or other
  misc_feature (486)..(486): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagagcccacctctcctggtagggccaggtcggagttgttgctaagtacctagcctaggtaccaacagaaacctggccaggcctcccgaggctcctcatctatgatgcactccaacgcggtcacgtcggacccaaccccgagaccgtaggttccaggtcggccgtaggtcggggtctaggggacaggtacttcgactcctaccgaccgtcagacaaatcgtacacgtcctagaattattttacgcttaagttttacttacgtagtcagtctacggtccgtttaccnccgacggtcccgtcgttaccgtacgggtttccgggggaccgggggtaactaacggggtaggaacgtacgttacgaacggtaaccgtaaacgttcgggtacggtaccgtcggacctaaccgttacgttccgttcgttcctttacgtacctttcccgttaccccg

SEQ ID NO: 307341 - DNA, 643 bp, Homo sapiens
  misc_feature: GZ8MTXP02FU90J.44.37.D04.1.454.CMB.2.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (399)..(399): a, c, t, g, unknown or other
  misc_feature (399)..(399): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtagggccaggtcggagttgttgactaaagtacctagcctggtaaccaanagaaacctggaccaggcctccaggctccnatctatgatgcataccaaagnggtcacgtcggacccaccccgagacaggttcaggtggccgtaggtgggtctagggacacgtacttcactctacaccgtnagctaaatcgtacagctagaagtacgtttacgacgtaacttacttactacgtaccaaactaaattatttactttttactaccgtttaacgttacggttttacggaccggtaacggggtaaccgtaaacggtcggtaagggaagtaagtaacgtaaaaggtaacgttcgggttaggttacgaccgtaacctacgttactaacgtttaccttacttacttcccgtttacccgtacctactttaccg

SEQ ID NO: 307342 - DNA, 612 bp, Homo sapiens
  misc_feature: GZ8MTXP02IX7WL.44.37.D04.1.454.CMB.2.raw
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggganagagccacctctcctggtacggccagtcggagtgttgactaagtacctagcctaggtaaccaacaagaaaccgtggaccaggcctacccgaggcctcctcatctatgatgcatccaacgaggtcacgtcggaccacccgagacgtagttcaggtcgcgtaggtggtctagggacaggtacttcgactcacgaccgtnagacaatcgacngctagaagttntttagacttagtttatacgtgtcaagtcagtccttccacgcgggaccctcgttaccgtaacgggtttccgggggacgggggaacctaagggtcgggaacgtacgtacgaaacggaacggtaacgttgggacggtactcggaccctaacgtacgttcgtttcgtacctttacccgtccgtttacccgtcccg

SEQ ID NO: 307343 - DNA, 548 bp, Homo sapiens
  misc_feature: GZ8MTXP02FNDA8.44.37.D04.1.454.CMB.2.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccacctntcctgtagggccagtcggagtgttgctaagtcctagcctggtaccaanagaaacctggccaggctcccaggctcctcatctatgatgcatccaacnggtcactggccacccagacnggttcagtgccagtgggtctggggacaggacttcactctacacgtcagcaatgtacagtccagaagtattttgcttaagtttattaactgtactagcagtcgttccctccgacggtccgctcgtacgtttcggggccgggggaccgagggtggagtacgtcgaaggacgtaacgtcggtcgcgcggacaaccgtatcgtcgtacttcacttcctttccccg

SEQ ID NO: 307344 - DNA, 648 bp, Homo sapiens
  misc_feature: GZ8MTXP02GC1TS.44.37.D04.1.454.CMB.2.raw
  modified_base (202)..(202): a, c, t, g, unknown or other
  misc_feature (202)..(202): n is a, c, g, or t
  modified_base (424)..(424): a, c, t, g, unknown or other
  misc_feature (424)..(424): n is a, c, g, or t
  modified_base (511)..(511): a, c, t, g, unknown or other
  misc_feature (511)..(511): n is a, c, g, or t
  modified_base (633)..(633): a, c, t, g, unknown or other
  misc_feature (633)..(633): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctggtacgggccaggtcggagtgttgctaagtcctagcctggtaccaacagaaacctggccaggctcccaggctcctcatctatgatgacatacccaaacgaggggtccaacgtcggacccaacccccgagtacctagggttcagggttcggacccgagggttggggtctaggggtacacggttacttcgacctcgtccaacccgttnaacgtcaaagttcgaaccaaggtccctaggtaaacgttattttcggacttaagttttattactgttacaggtctaggtccgttaccncgacgggtcctaccttcgtaccggtttcggggacgggggtaaccaaggggtcggaacgtacgtacgaacggtaacgtaacgtgggtacgctcgacctaaccgcgttccgtacgttccttacnctttcccgttacccg

SEQ ID NO: 307345 - DNA, 611 bp, Homo sapiens
  misc_feature: GZ8MTXP02JAX9F.44.37.D04.1.454.CMB.2.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagacgccaccctctcctgtagggccagtcggagtgttgctaagtacctgctggtacaacagaactgccagctccagctccnatctatgatgcatccaanaggtcacgtggaccacccagacagttcaggtgcagtggtcnggacagcttcactcacaccgtnagcaatgacagcctgaagtacgtttagactaagtttattactgtactaacggtctaacgtccgttccttaccgaccgggtacccgtcctaccgtacggtttccgggggaccggggggtaaccgtaacggggtacggaacggtaacgttaccggaaacggtaacggtaaaccgttgggacggtaccgtcggaccctaacgtacttacgttaccgttccgtttaaccgtaccgtttcccttaacccccgg

SEQ ID NO: 307346 - DNA, 579 bp, Homo sapiens
  misc_feature: GZ8MTXP02HZB6I.44.37.D04.1.454.CMB.2.raw
  modified_base (293)..(293): a, c, t, g, unknown or other
  misc_feature (293)..(293): n is a, c, g, or t
  modified_base (409)..(409): a, c, t, g, unknown or other
  misc_feature (409)..(409): n is a, c, g, or t
  modified_base (459)..(459): a, c, t, g, unknown or other
  misc_feature (459)..(459): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgactacagtctccaggcaccctgtctttgtctccgagggagagacgccaccctctcctgtagggccagtcggagtgtgctaagtacctagcctggtaccaacagaaacctggccaggcctcccaggcctccnatctatgatgaccatacccaaacgagggtccaacgtggacccaccccgagaccgtaggttcaggttggccctagggtcggggtctcggggacacgactttcacttcgtccaccgtnaacgtcaatcgtacaggcctagtacgtattttgacttagtttatactgtntagtacgagtcgttctccgtacgccgtccgtccgacgttcgggcggggtaccggacggtagtagacgtacgagacgtaacgtacgtgcgtcgcgaacgtactcgtcgtctctctctcccg

SEQ ID NO: 307347 - DNA, 514 bp, Homo sapiens
  misc_feature: GZ8MTXP02FFI17.44.37.D04.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (335)..(335): a, c, t, g, unknown or other
  misc_feature (335)..(335): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatatttgtgttgacacagtctccaggcaccctgtctttgtctccagggganagagccaccctntcctgtagggccagtcggagtgttgctaagtacctagcctggtaccaanagaaacctggccaggctcccaggctcctcatctatgatgcatccaacaggtcactggcaccccagacaggtnagtggccagtggctggggacagacttcactctcaccgtcagcaaatgtacagcctgaagtattttgctagtttattatgtcagtcagcgttcctccacggccgcctcacgtttcgggcgggggacaacgggtggagatcagacgaagtgtcgctgcaaccatctgtcttcactctcccg

SEQ ID NO: 307348 - DNA, 767 bp, Homo sapiens
  misc_feature: GZ8MTXP02FFKW9.44.37.D04.1.454.CMB.2.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtcctccaggccacctgtctttgtctcgagggganagacnccacctntcctgtacgggccaggtcggagtgttcgactaacgtacctagcctaggtaaccaacacggaaacctggaccacggtcctacccgaggcctcctctatccgtaatggaatcgacactaccgaacgtaggggtaccacgtacggacccaacccccaggtaacccgtagggttccgaagggtcggcccggtagggttcggggtaccgtaggggaaccacggttacttccacgtcttccgaccgtcacgtactaaatcgtaaacacggtcctaaggtaagtttattttacggactttaaggtttttaaacttaccgttaggttaccaaacgggttcccaaacgggtttcccggttttacccccgtacccgggtaccggggtaccccgtttacccgtttaccggggttacccggggttaccgggggggtaacccgggggaaaccggtaagggggtacggaacgtaacgtaccggaaacggtaaacgtaccggtcgggtacgtccgtacgaccgtaaccgtacgtttccgtcgttacctacctaccgttccccgtacccg

SEQ ID NO: 307349 - DNA, 702 bp, Homo sapiens
  misc_feature: GZ8MTXP02I5DD1.44.37.D04.1.454.CMB.2.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgctccgagggganagacgccacctctcctggtacgggccaggtcggagttgttgactaagtcctagcctaggtaaccaagaacgaaaccgtggccacggcctccccgaggtccctcctacgacttctaagtcgagtcgcctaacgtacccgaaacgtcggggtccacgtcggacccaccccgagacgtaggttcagggttgacccgtagggtggtcaggggacacggttcctcgaccttcaccgacgtcaacgactaacgtacgtacgacgtccgttagaacgtttgtttacggactttaagttttacgttaccgtagtactagtacgttacggttcccgtttaccgacccggtacgggtccctaccgttccggttaccggtttccgggggaacgggggtaccgtaagggggtcggaacgttacgtacggaaacggtaccggtaaacgttggtaccgggcttacggacctaaccgtactccgttgttaccctacgtacctttcccgtaacccg

SEQ ID NO: 307350 - DNA, 630 bp, Homo sapiens
  misc_feature: GZ8MTXP02J10NA.44.37.D04.1.454.CMB.2.raw
  modified_base (199)..(199): a, c, t, g, unknown or other
  misc_feature (199)..(199): n is a, c, g, or t
  modified_base (402)..(402): a, c, t, g, unknown or other
  misc_feature (402)..(402): n is a, c, g, or t
  modified_base (484)..(484): a, c, t, g, unknown or other
  misc_feature (484)..(484): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctcagggganagagccaccctctcctggtacgggccaggtcggagtgttgactaagtacctagcctggtaaccaacagaaacctggccaggcctccaggctcctcatctatgatgcatccgaaacaggggtcaacgtcggaccaccccagactaggttcaggtcggcccagggtgggtctaggggacacggtacttcgacttctccgaccgtnaggtaccaatcgtacacgcctagaagttatttgactagttttatacgtgtacagctagtccgttacctaccgacgggtcccncgttaccttaccgggttccggggaaccgggggtaccaaggggttacgggacgttaacgtacggaacggaaccggaaaccgttggtacggaccttcggaacctaacccgtattccgtcggttccttactaaccgttaccttcccccg

SEQ ID NO: 307351 - DNA, 798 bp, Homo sapiens
  misc_feature: GZ8MTXP02FMBG8.44.37.D04.1.454.CMB.2.raw
  modified_base (206)..(206): a, c, t, g, unknown or other
  misc_feature (206)..(206): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgttcttttgtcctccgagggganagacgcccaccctctcctgtacgggccaggtcggagtgttgactaagtacctagcctaggtaaccaacgaagaaacctggaccaggcctacccgaggcctcctcatctatgatgacactaccaacgtagggtcacgtcggacccaccccgagtaccgtaggttccaaggttcggaccgtagggtcggggtcgtaggggacacggttaccttccgacttcctaccgtacccgtcaacggtactaaagttacgtaaccacggtaccgtaaggtaaacgtttagtttttacggaccgtttaaaggtttttaacttacgttacgtaaccgtaacggtaccgttaacggttccccggttttacccgtacccggtaaccggggtccccgttacccgtttaccggttaacccgggggttttccccggggggaaccggggggtaaacccggtaagggggtcgggtaaacgggtaacgtaaccggggtaaacggaaaccgggttaaacggttcggggttaaccgggcgtaccgggtaccctaacccgtttacgttaccgttccgtttaccgtttcctaccgtttcccccgtttacccccgg

SEQ ID NO: 307352 - DNA, 233 bp, Homo sapiens
  misc_feature: GZ8MTXP01C0B1W.39.13.B02.1.454.CMB.2.raw
  modified_base (233)..(233): a, c, t, g, unknown or other
  misc_feature (233)..(233): n is a, c, g, or t
tcagtcgcactagtcacgaccggtgctcgatttagtctagcgactttgggtttgcgactttgggtttggggccagggaaccctggtcaccgtctcctcagcctccaccaagggcccatcggtcttcccctggcaccctcctccaagagcacctctggggcacagcggccctgggctgcctggtcaaggactacttccactagtgcgactgagcgggctggcaaggcgcatagn

SEQ ID NO: 307353 - DNA, 234 bp, Homo sapiens
  misc_feature: GZ8MTXP01AESO7.39.13.B02.1.454.CMB.2.raw
  modified_base (231)..(234): a, c, t, g, unknown or other
  misc_feature (231)..(234): n is a, c, g, or t
tcagtcgcactagtcacgaccggtgctcgatttagtctagcgactttgggtttgcgactttgggtttgggccagggaaccctggtcaccgtctcctcagcctccaccaagggcccatcggtcttcccctggcaccctcctccaagagcacctctggggcacagcggccctgggctgcctggtcaaggactacttccactagtgcgactgagcggctggcaaggcgcatagnnnn

SEQ ID NO: 307354 - DNA, 544 bp, Homo sapiens
  misc_feature: GZ8MTXP01CGLLC.39.13.B02.1.454.CMB.2.raw
  modified_base (222)..(222): a, c, t, g, unknown or other
  misc_feature (222)..(222): n is a, c, g, or t
  modified_base (431)..(431): a, c, t, g, unknown or other
  misc_feature (431)..(431): n is a, c, g, or t
tcagtcgcactagtcacgaccggtgctcgatttagtctagcgacttccgcggggggtctcaggaggcagcactctcaggacatctccaccatggcctgggctctgctgctcctcaccctcctcactcagggcacagggtcctgggcccagtctgccctgactcagcctgcctccgtgtctgggtctcctggacagtcatcaccatctcctgcactggaaccngcagtgacgttggtgttataactatgtctcttggaccaacatcacccaggacaaacgtccccaaatgatgatttatgagtcactaaacgcctgagggtttcaatcgtcttcctctgctccaagtctggcaacacggccctcctgaccatctctgggctccgaggctaggacggacgaggctactctaattatgcagtctcatatacaanctaattatctacgttgggtgttcgggcggttagggacccgaccgtggacccgttcgttacggttccaacggccccgaacgggtcctccggcccccgttcggttccgtaacccg

SEQ ID NO: 307355 - DNA, 549 bp, Homo sapiens
  misc_feature: GZ8MTXP01ENY4O.39.13.B02.1.454.CMB.2.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
  modified_base (438)..(438): a, c, t, g, unknown or other
  misc_feature (438)..(438): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtcctgggtctcctggacagtcgatcaccatctcctgcactggaaccngcagtgacgttggtgttataactatgtctcttggtaccaacatcaacccaggacaaacgtccccaaangatgtatttatgaggtcactaaacggccctcgagggtttctaatcgcttcctctggctccaagtctggcaacacggccctccctgaccatctctgggctccagctggaggacgaggctctctattattgcagtctcataatacaanctaattatctacgttggggtcgtttcgggcggaggggacccgttaccgtggtacccgttgttacggttccaacggacccaacggcctcgcccccgtcggttccctaacccg

SEQ ID NO: 307356 - DNA, 509 bp, Homo sapiens
  misc_feature: GZ8MTXP01D474W.39.13.B02.1.454.CMB.2.raw
  modified_base (223)..(223): a, c, t, g, unknown or other
  misc_feature (223)..(223): n is a, c, g, or t
  modified_base (402)..(402): a, c, t, g, unknown or other
  misc_feature (402)..(402): n is a, c, g, or t
  modified_base (449)..(449): a, c, t, g, unknown or other
  misc_feature (449)..(449): n is a, c, g, or t
  modified_base (482)..(482): a, c, t, g, unknown or other
  misc_feature (482)..(482): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggtaccaacatcacccaggcaaagtccccaaactgatgatttatgaggtcactaaacggccctcagggggtttctaatcgcttcctctggctccaagtctggcaacacggcctccctgaccatctctggctcagctgagcgaggctntctattattgcagctcatatacagcattatcacttgggtgttcgggnggagggccgttacgtgaccgttcgttaggttcngcccaaggctcgcccctggttctaacc

SEQ ID NO: 307357 - DNA, 523 bp, Homo sapiens
  misc_feature: GZ8MTXP01C8Y8R.39.13.B02.1.454.CMB.2.raw
  modified_base (221)..(221): a, c, t, g, unknown or other
  misc_feature (221)..(221): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctcctgcactggaaccngcagtgacgttggtgttataactatgtctcttggaccaacatcacccaggcaaagtccccaaactgatgatttatgaggtcactaaacggccctcgaggggtttcaatcgctttcctctggctccaaagtctggcaacacggcctccctgaccatctctggctcagctgagacgaggctctctattattgtcagtctacatataacaagctattatcacgttgggtgttcgggcggagggaccgacgtcgtaccgttcgttcggttcaagcccaaggctacgcccccgtcgttccgtaaccg

SEQ ID NO: 307358 - DNA, 505 bp, Homo sapiens
  misc_feature: GZ8MTXP01AS2QK.39.13.B02.1.454.CMB.2.raw
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaacggccctcaggggtttctaatcgcttcctctggctccaagtctggcaacacggcctccctgaccatctctgggctccaggctgaggacgaggctctctattattgcagcttcatatacagcatatnactggtgttggcggngggcgacgtcgacgttcgttgttcngccaacgctgcccctccggttcgtcc

SEQ ID NO: 307359 - DNA, 550 bp, Homo sapiens
  misc_feature: GZ8MTXP01CITZD.39.13.B02.1.454.CMB.2.raw
  modified_base (219)..(219): a, c, t, g, unknown or other
  misc_feature (219)..(219): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcatcacatctctgcactggaaccngcagtgacgttggtgttatactatgtctctgacaacatcacccaggacaaacgtccccaaactgatgtatttatgaggtcacgtaaacggccctgtagggtttctaatcgcttcctctggctcaagtctgcacacgcctcctgaccatctcgtggctccgagctgaggacgagctctactattattgcagtctacaatactaacaagctattactctacgttgggtgttcgggacgggacggggtacccttacgtacggtacccgttacgttacggttaccgaacggaccccgaagggtccctccgttcccccgttcgggttcctaacccg

SEQ ID NO: 307360 - DNA, 555 bp, Homo sapiens
  misc_feature: GZ8MTXP01EE127.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcacatctcctgcactggaaccagcagtgacgttggtggttatactatgtctctgtaccacatcacccaggacaaacgtccccaaactgatgatttatgagtcactaaacggccctacgagggtttctaatcgcttcctctggctcaagtctggcaacaccggccctccctgacatctcgtgggctccgaggctgaggacgagctctctattatgcagctacataatacaaagctaattatctacgtttgggtcgttcgggcgggttagggacccgttaccgtagtacccggttcgttacggggttccaacggacccgaacgggtcctccggcccccgttcgggttcctaaccccg

SEQ ID NO: 307361 - DNA, 748 bp, Homo sapiens
  misc_feature: GZ8MTXP01EJ5BC.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatcctctgcactggaaccagcagtgtacgttggtagttaataactatgtctcttgaaccaacatccaccgaggacaaaccgtaccccaaatgatgtatttagtgaggtacaacgtaaaccggccctacgtagggtttactaagtcgtcttcccgtcgtcggtcctaccgtaaagttccgtacggccaaaccgtacccgggtccccttaccccgtaacggaaaacctcttcccgttccgttacggggcccttaccggaggtccgtagggaacgggaaccggtacgggtccttaccgttacttaaatttacgttcggtaccgtacgtccttaaccaaatttaacgtaaaccgaagtaccttaaatttaaccttaccgttaacgggttttagggggttcgggtttaacccgggggacggggttaaccggggtaaccccgttacccggttaccggtaaccccggtttacgttacgggttaccgtaaccggaaccccggtaacgggtcccgtcccggttcccccccgttcgggttaacccgtttccccg

SEQ ID NO: 307362 - DNA, 507 bp, Homo sapiens
  misc_feature: GZ8MTXP01BV924.39.13.B02.1.454.CMB.2.raw
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaacggccctcgagggtttctaatcgcttcctctggctcaagtctggcaacacggctccctgaccatctctggctcaggctgaggacgaggctctctattattgcagctcatatacaagcattatctacttgggtgttcggtcggagggcccgacgtgaccgttcgttagggttcaagccaagctcgcccctgttctcc

SEQ ID NO: 307363 - DNA, 551 bp, Homo sapiens
  misc_feature: GZ8MTXP01AGFNQ.39.13.B02.1.454.CMB.2.raw
tcagtcgcactagtcacgaccggtgctcgatttagtctagcgactttgggctgagctgcctttttcttgtggctattttaaaaggtgtccagtgtgaggtgcagctgttggagtctgggggaggcttggtacaggccggggggtccctgagactctcctgtgcagcctctggattcaccttcagcagctatgccatgacctgggtccgccaggctccgagggaagggactggagtgggtctcgtctattagtggaagtggtgcttatacaaactacgcagcctccgtgaagggccgcttcaccatctccagagactattccaagagcactctgtatctgcaaatgaacagcctgaagtgccgagacacggccctatattattgtgcgaaatggtgggggagtgggggctacgtccgtggtcgtttgactacgtgggggccgtaggggacgcccgtggtcaccggtctcctcacgtcctccaccgaagggcccattccggtccttccccgtggccgcccgttgcctcccaggcgcacccttccgaagcgccg

SEQ ID NO: 307364 - DNA, 543 bp, Homo sapiens
  misc_feature: GZ8MTXP01BP20X.39.13.B02.1.454.CMB.2.raw
  modified_base (222)..(222): a, c, t, g, unknown or other
  misc_feature (222)..(222): n is a, c, g, or t
  modified_base (298)..(298): a, c, t, g, unknown or other
  misc_feature (298)..(298): n is a, c, g, or t
  modified_base (431)..(431): a, c, t, g, unknown or other
  misc_feature (431)..(431): n is a, c, g, or t
  modified_base (502)..(502): a, c, t, g, unknown or other
  misc_feature (502)..(502): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccngcagtgacgttggtgttataactatgtctcttggtaccaacatcacccaggcaaagtccccaaactgatgatttangaggtcactaaacggccctcgagggtttctaatcgcttcctctggctccaagtctggcaaacacggccctccctgacccatcctctggctccaggcctggacggacgaggctctctattattgcagctcatanacaagctattatctacgttgggtgttcgggcggacggggtacccgacgttcgaccgttcgttacggttacncggacccgtaaaggccctcggccccctcggttcctaacccg

SEQ ID NO: 307365 - DNA, 535 bp, Homo sapiens
  misc_feature: GZ8MTXP01DFEV0.39.13.B02.1.454.CMB.2.raw
  modified_base (437)..(437): a, c, t, g, unknown or other
  misc_feature (437)..(437): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttgtaccaacatcacccaggcaaagtccccaaactgatgatttatgaggtacactaaaccggtccctacgtagggggtttctaatcgctttcctctggctccaagtctggcaacacgcctccctgaccatctctgggctccagctgagacgaggctctctattattgcagctcatataacaanctattatctacttgggtgttcgggcggttacggggaccgaccgtggtaccgttcgttagggttcaacgcccaaggctcgccccctcggttcctaaccc

SEQ ID NO: 307366 - DNA, 552 bp, Homo sapiens
  misc_feature: GZ8MTXP01DC3HJ.39.13.B02.1.454.CMB.2.raw
tcagtcgcactagtcacgaccggtgctcgatttagtctagcgacttctgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacctatctcctgcactggaaccagcagtgacgttggtagttatactatgtctctgtacaacatcaccagacaaacgtaccccaaactgatagtatttatagagttttttacaactaaacgcctacgtaggttactaatcgtccttctctgctctaaagtctgacaacacgcctccctcgacactctcgtcggctcgagctagacggacgacggctctcttattattggctagtctactaataataactaagtactattatactacgttgggtggttcgggcgggacgggaccgtaccgtcgttaccgttcgttacggtcacgtaaccgacggcttccgtccccgttcggtcc

SEQ ID NO: 307367 - DNA, 531 bp, Homo sapiens
  misc_feature: GZ8MTXP01AI670.39.13.B02.1.454.CMB.2.raw
  modified_base (224)..(224): a, c, t, g, unknown or other
  misc_feature (224)..(224): n is a, c, g, or t
  modified_base (377)..(377): a, c, t, g, unknown or other
  misc_feature (377)..(377): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggaccaacatcacccaggcaaagtccccaaatgatgatttatgaggtcactaaacggccctcgaggggtttctaatcgtcttcctctggctccaagtctggcaacacggctcctgacatcnctggctcagctgaggacgaggctctctaacttattgctagctcatatacaagcattatcgacttgggtgttcggcgggagggacccgaccgtcggtaaccgttcgtttaacggcaacgggcccaagggtcctcggcccctcgggttctaacccg

SEQ ID NO: 307368 - DNA, 611 bp, Homo sapiens
  misc_feature: GZ8MTXP01CN9LS.39.13.B02.1.454.CMB.2.raw
  modified_base (211)..(211): a, c, t, g, unknown or other
  misc_feature (211)..(211): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (602)..(602): a, c, t, g, unknown or other
  misc_feature (602)..(602): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctggggggaggcttggtacaggcggggggggtccctgagactctcctgtacagtctctggattcagctttagcacctatgccatgagctggggtccnccaggctccgaggggaaggggctggagtgggtctcatccattagtggtgccaggtggtggtaatacatattatgtggactccggtgaaggccgttcacatcncaganacaattccaagaacactctgtatctagaccaaatgaacagcctagagcgaccgagacaccggacctatacttactgtagacgaaactctacccgtattgtacgtttcgaccacctaacttcgactccggtacggggggacccgaacggggaaccccgttgggtaccacccgttccctcctaccgacgtccctacccaacccgacggggcccctacgttccgggttcccttcccccgtcggcccaccccgttcccttacccaacgcgccaccctcggcggggccncgaaccggg

SEQ ID NO: 307369 - DNA, 505 bp, Homo sapiens
  misc_feature: GZ8MTXP01EHEPU.39.13.B02.1.454.CMB.2.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttgggggttatgactatgtctcctggtaccagcaatatccaggcacagcccccaaatcatcatttangagtcagtaatcggccctnagggtttcaatcgnttctctggctccaagtctggcaacacgcctcctgaccatctcgtgggctccgaggctaggaggacgaggctagatttattacgtgccagctcatttgacaatcagtgagtcttagttgtcttggaaagttgggaaccttaggttcaagtcgtctggtcagccccgaagaacccc

SEQ ID NO: 307370 - DNA, 515 bp, Homo sapiens
  misc_feature: GZ8MTXP01CJAQG.39.13.B02.1.454.CMB.2.raw
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggaccaacatcacccaggcaaagtccccaaactgatgatttangaggtcactaaacggccctcgagggtttcaatcgtcttcctctggctccaagtctggcaacacggcctccctgaccatctctgggctcaggctgaggacgaggctcgtctattattgctagcttcatataacagcattatctagttgggtgttcggcggagggaccgcgtcgaccgttcgttaggttcaacgccaaggctcgcccctcggttctcc

SEQ ID NO: 307371 - DNA, 649 bp, Homo sapiens
  misc_feature: GZ8MTXP01DDY4D.39.13.B02.1.454.CMB.2.raw
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
tcagtcgcactagtcacgaccggtgctcgatttagtctagcgactttgggctgagctgcctttttcttgtggctatgttaaaaaggtgtccagtgtgaggtgcagctgttggagtctggggggaggcttggtacaggcggggggggtccctgagactctcctgtacagtctctggattcagctttagcacctatgccatgagcgtggtccncaggctccgaggggaagggctggagtggtctcatcattagtggtgccagtggtagtaatacatatatgtgactcgtgaggccgtcacntctcagagacaatcaaagaacnctctgtatctagaccaaatgaacngcctagagcgaccgagacacggcctatacttactgtagacgaaactcctacccgtacttacggtacgtttacgacctaacctaacgtttcgaaccgttcccggtacggggggtacccgtaacggggtaaccccgttcggtacccgtaccccgttccttcccttaccgaccggtacccctacccgaaacccgaaccggggcccctaacgttccccgggttccccttcccccgtcggaccccttaccccgttccttacccgaacggaccgccgtacccgttcgggacgggggtccaaccgcccggg

SEQ ID NO: 307372 - DNA, 530 bp, Homo sapiens
  misc_feature: GZ8MTXP01B5K3K.39.13.B02.1.454.CMB.2.raw
  modified_base (222)..(222): a, c, t, g, unknown or other
  misc_feature (222)..(222): n is a, c, g, or t
  modified_base (391)..(391): a, c, t, g, unknown or other
  misc_feature (391)..(391): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctctgcactggaaccngcagtgacgttggtgttatactatgtctcttggtaccaacatcacccaggcaaacgtccccaaatgatgatttatgaggtacactaaacggccctcgtagggtttctaatcgtcttcctctggctccaagtctggcaacacggcctcctgaccatctcgtggctcgggntgagacgaggctcgtctattattgcaggctcatatacaagcattatctacgttgggtacgttcggcggagggaccgaccttggaacccgtgttaggttcgaacgccctaagggcctcgccccttcggtccaacgttccc

SEQ ID NO: 307373 - DNA, 502 bp, Homo sapiens
  misc_feature: GZ8MTXP01A95NC.39.13.B02.1.454.CMB.2.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (449)..(449): a, c, t, g, unknown or other
  misc_feature (449)..(449): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggactcctggacagtcgatcaccatctcctgcactggaaccngcagtgacgttggncttataattatgtctcctggttccaacagcattcaggcagcgccccgaaactcttaattatgagtctttcgtcgcctnagggttctagtcgcttctcggctcagtctggcaacacggcctcctgaccatctctagactcaggctgaggacgaggctgactattattgcagctcatatactgaagtcaatggtatccatggcttggttcggnggagggacaagttcgaccgtcgtaggtcacgcccgaaggtccttcgtcccccg

SEQ ID NO: 307374 - DNA, 546 bp, Homo sapiens
  misc_feature: GZ8MTXP01A563O.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggaccaacatcacccaggcaaagtccccaaatgatgatttatgaggtcactaaacggccctcgagggtttctaatcgcttcctctggctccaagtctggcaacacgcctccctgaccatctctgggctcaggctgaggacgaggctctctattattgcagctcatatacaagcattatcctagtttgggtgttcgggcgggacgggacccgttaccgtacggtacccgttcgttcgggttcaacggaccccgaagggccctccggccccccgttcgggttccgtaacccg

SEQ ID NO: 307375 - DNA, 624 bp, Homo sapiens
  misc_feature: GZ8MTXP01BM8XX.39.13.B02.1.454.CMB.2.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (436)..(436): a, c, t, g, unknown or other
  misc_feature (436)..(436): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggaccaanatcaccaggcaaacgtccccaaatgatgatttangagtcacgtaaacgccctacgtagggtttctaatcgtcttcctctggctccaagtctcggcaacaccggccctccctcgacccatcctcgttgggcctccgaggcctggaggacgagtctcttactattattgcgtancttacattaacaaccaaagtctaaatttactccgttaacgtttgggggtggtttccgggggaccgggttaacgggggtaccccgacccgtacggtaaccccgggtttaccgttagggttacccaacccggggtacccaaacggggttcccccgtaccccggttcccccgttccggttcccgtaacccg

SEQ ID NO: 307376 - DNA, 619 bp, Homo sapiens
  misc_feature: GZ8MTXP01AFLCN.39.13.B02.1.454.CMB.2.raw
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (609)..(609): a, c, t, g, unknown or other
  misc_feature (609)..(609): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcgggggggtccctgagactctcctgtacagtctctggattcagctttagcacctatgccatgagctgggtccnccaggctccgaggggaagggctggagtgggtctcatccattagtggtnccaggtggtgtaaatcatatangtggactcgtgacggccgttnaccatcncaganacaattccaaagaaccactctagtatctgaccaaatgaaacngcctaggacgcgaccgaggaccaccggtccctatacttactgtagacgaaactcctacccgtattgacggtttcgaccctaacctaaacgtttcgacttccggtacggggggaccgtaacggggtaaccccgttcggtacctacccgttcctcctcgacgccctacccgacccgaacgggccctacgttcccgggttcccttccccgtcggtcccaccccttccgacccaacgacgcctacccgtcggccggggcnccgaaccggg

SEQ ID NO: 307377 - DNA, 555 bp, Homo sapiens
  misc_feature: GZ8MTXP01ALZEC.39.13.B02.1.454.CMB.2.raw
  modified_base (207)..(207): a, c, t, g, unknown or other
  misc_feature (207)..(207): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (537)..(537): a, c, t, g, unknown or other
  misc_feature (537)..(537): n is a, c, g, or t
tcagtcgcactagtcacgaccggtgctcgatttagtctagcgactttgggctgagctgccttttcttgtggctatgttaaaaggtgtccagtgtgaggtgcagctgttggagtctgggggaggcttggtacaggcgggggggtccctgagactctcctgtacagtctctggattcagctttagcacctatgccatgagctgggtccnccaggctccgagggaaggggctggagtgggtctcatccattagtggtgccaggtggtggtaatacatattatgtggactccgtgaaggccggttcaccgatctccagagacaattccaagaacactctgtatctgaccaaatgaacagcctagagcgcgaggacacggccctatattactgtgacgaaatctcccgacttagaggtttgccaccaactttcgactccgtcggggggccgacgggaaccctcggtcaccgtctcctccagcctccncaacgggcccnttccggtccttccccgtcgccacccttccttccaacgcgcaccncgttcggggcaacgccgg

SEQ ID NO: 307378 - DNA, 587 bp, Homo sapiens
  misc_feature: GZ8MTXP01AOE9U.39.13.B02.1.454.CMB.2.raw
  modified_base (270)..(270): a, c, t, g, unknown or other
  misc_feature (270)..(270): n is a, c, g, or t
  modified_base (436)..(436): a, c, t, g, unknown or other
  misc_feature (436)..(436): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctggggcccaggtctaggcccctgactcagcctgcctccgtgtctgggtctcctggacagtcgatcaccatctcctgcactggaaccagcagtgacgttggtgttataactatgtctcttggtaccaantcacccaggcaaacgtccccaaatgatgatttatgagtcacgtaacggcctcgagggtttcaatcgtctttcctctggctccaagtctggccaaacaccggtccctccctgaccatccctcgtcgggcctcgaggtctggaacggacgaggccttctcttaatttntcgcgtacgtctactaactaacgtaactagtacttaattactcgtacggtttgggtcggtaacgggacggacgggtaccgttaccgtacggtaccgttacgttcggacgaaccgtaccgaacggtcctcccggttccccgtcgttcctccg

SEQ ID NO: 307379 - DNA, 559 bp, Homo sapiens
  misc_feature: GZ8MTXP01C5HCS.39.13.B02.1.454.CMB.2.raw
  modified_base (222)..(222): a, c, t, g, unknown or other
  misc_feature (222)..(222): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (424)..(424): a, c, t, g, unknown or other
  misc_feature (424)..(424): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctctgcactggaaccngcagtgacgttggtgttataactatgtctctgtaccaacatcaccaggcaaacgtccccaaatgatgatttatgagtcactaaacggccctacgtagggtttctaatcgtcttcctctggctcaagtctggcaacncggcctcccngaccatctctgggctcaggctggaggacgaggctcgtctattatgcagctacatanacaagctaattatctacgttgggtcgttcgggcgggacgggtaccgaccgttacggcccgttacgttacggttacccaacgggccccgtaagggtcccgtcccggttccccccgttcgggttcccttaaccccgg

SEQ ID NO: 307380 - DNA, 525 bp, Homo sapiens
  misc_feature: GZ8MTXP01ET4KJ.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcttggtaccaacatcacccaggcaaagtccccaaatgatgatttatgaggtcactaaacggccctacgagggttctaatcgcttcctctggctcaagtctggcaacacgcctcctgacatctctggctcgagctgacggacgagctctctattatgctagctcatatacagctatatctacgttgggtggttcgggcgggacgggaccgacgtcggtaccgttcgttacggttcaacggacccgaaggcctcgcccctcggttaactcccg

SEQ ID NO: 307381 - DNA, 543 bp, Homo sapiens
  misc_feature: GZ8MTXP01DX07L.39.13.B02.1.454.CMB.2.raw
  modified_base (222)..(222): a, c, t, g, unknown or other
  misc_feature (222)..(222): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccngcagtgacgttggtgttataactatgtctcttggtaccacatcacccaggcaaagtccccaaactgatgatttatgagtcactaaacggccctcagggtttctaaatcgcttctctggctccaagtctggcaacacggccctccctgaccatctctgggcctcgaggctgaggacgaggctctctattattgctagctcatatacaagcattactctacttggggtgttcgggcggttaggggaccgaccgtacggtacccgttcgtttacggttaccaacgacccaacgggcctcggcccccttcggttccgttaacccg

SEQ ID NO: 307382 - DNA, 547 bp, Homo sapiens
  misc_feature: GZ8MTXP01ASP4I.39.13.B02.1.454.CMB.2.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctcttggtacaacatcacccaggcaaagtccccaaactgatgatttangagtcactaaacgccctgagggtttctaatcgcttctctggctccaagtctggcaacacggcctcccngaccatctctgggctccgaggctggaggacgaggctctctattattgcagctcatatacagctattatctaacgttgggtgttcggcgggttacgggcccgttaccgtacgtacccgttcgttacggttcctaacggacccgaacggtccgtacggccccccgttgggttcccgtaacccg

SEQ ID NO: 307383 - DNA, 525 bp, Homo sapiens
  misc_feature: GZ8MTXP01BFFC0.39.13.B02.1.454.CMB.2.raw
  modified_base (432)..(432): a, c, t, g, unknown or other
  misc_feature (432)..(432): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggaccaacatcacccaggcaaacgtccccaaactgatgatttatgaggtcactaaacggcctcgagggtttctaatcgcttcctctggctcaagtctggcaacacggccctccctcgaccatctctgggctcaggctgaggacgaggctctctattattgcagtctcatatacaancaattatcacgttgggtgttcgggcggacgggacccgacgtcggtacgttcgttaggttcaacgcccaaggcctcgcccctcggttctaaccg

SEQ ID NO: 307384 - DNA, 550 bp, Homo sapiens
  misc_feature: GZ8MTXP01EZHDI.39.13.B02.1.454.CMB.2.raw
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcactggaaccngcagtgacgttggtgttataactatgtctcttggaccaanatcacccaggacaaacgtccccaaatgatgtatttangagtcactaaacggcctcgagggtttcaatcgcttcctctggctcaagtctggcaacacggccctccctgacccatctctgggcctccgaggctggacggacgaggcctctcttattattgcgagtctacataatacaagctaattatctacgttggggtgttcgggcgggacgggacccgaccgtcggtacccgttcgttaggttccaacgccccgaaggcctccggcccccgttcggttcctaacccg

SEQ ID NO: 307385 - DNA, 550 bp, Homo sapiens
  misc_feature: GZ8MTXP01AY0F0.39.13.B02.1.454.CMB.2.raw
  modified_base (358)..(358): a, c, t, g, unknown or other
  misc_feature (358)..(358): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcttggaccaacatcacccaggcaaagtccccaaactgatgatttatgaggtcactaaacggccctcgagggtttctaatcgcttctctggctcaagtctggcaacncggcctccctgaccatctctcgggctccgaggctggacggacgacggctcgtctattattgcagtctcatatacaagactattatctacgttgggtcgttcgggcgggacgggacccgttaccgtggtacccgttcgttacggttcaacggcccgaacggtcctccggcccccgttcggttaaccgttcccg

SEQ ID NO: 307386 - DNA, 620 bp, Homo sapiens
  misc_feature: GZ8MTXP01AH7F2.39.13.B02.1.454.CMB.2.raw
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctgaccaacacacccggcaaacgcccccgaagtcatgatttangacgtcactaatcgccctgagggtntctaatcgtcttcctctggcctaccaagtcctggccaaacgacccgggcctccccgtgaaccattcctcgttggggccttccgagggctagggaacgggtacgaggctaggtatttaacgttacgtggacaaggtcttacaacttacttaccaaagcgtaaacgtaacttacgttcgttcccgttttcgggaacggtaacgggacccgtaaggccgtacggtaacccggttccgttacgggttaccgaaccgccccgtaaacggtccctcccggttcccccgttccgggttcctaacccg

SEQ ID NO: 307387 - DNA, 527 bp, Homo sapiens
  misc_feature: GZ8MTXP01ET8XT.39.13.B02.1.454.CMB.2.raw
  modified_base (222)..(222): a, c, t, g, unknown or other
  misc_feature (222)..(222): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataactatgtctcttggtaccaacatcacccaggcaaagtccccaaaccgatgatttatgaggtcactaaacggccctcaggggtttctaatcgcttctcctggctccaagtctaggcaacacggccctccctgaccatctctgggctccaggctgaggacgaggctctctattattgcaggctcatatacaagcattatctacgttgggtgttcggcgggtacgggaccgaccgttgaccgtcgttacggttcagcccaaggctcgccccttcggtcaaccgttccg

SEQ ID NO: 307388 - DNA, 540 bp, Homo sapiens
  misc_feature: GZ8MTXP01BO8CX.39.13.B02.1.454.CMB.2.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccatctcctgcactggaaccagcagtgacgttggtagttanactatgtctctgacanatcaccaggcaaacgtccccaatgatgatttatgagtacactaaacggcctacgtagggttctaatcgtcttctctgctcagtctgcacgacgcctccngacactctcgtggctcgagcgtagaggacgagctcgtctattattcgctagcttacatactacaagtctaattntcgtacgttggggtcgttcgggcgggacgggtacccgacgtcggtacccgttcgttcgggacctaacggacccgtaaggtccctcccggcccccttcgggttcctcccg

SEQ ID NO: 307389 - DNA, 554 bp, Homo sapiens
  misc_feature: GZ8MTXP01DAUAM.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtgttaataactatgtctcttgtacaacatcacccaggcaaagtccccaaactgatgatttatgtaggtacactaaacggccctacgtagggtttctaatcgtcttcctctggctccaagtctgcaaacgaccggccctccctgaccatcctctgggctccgaggcgtagaggacgaggctctactattattcgcacgctacatataacagactattatctacgttgggttgtttgggcgggttacggggtaccgaccgtggtaccgttcgttcggttcaacgtcccgaaggccgtcgttacccccgtggttcctcccg

SEQ ID NO: 307390 - DNA, 538 bp, Homo sapiens
  misc_feature: GZ8MTXP01CXBIF.39.13.B02.1.454.CMB.2.raw
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagtcgcactagtcacgaccggtgctcgatttagtctagcgacttccggcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttaataactatgtntctggaccaacatcacccaggcaaacgtccccaaactgatgtatttatagagtcaacgtaaacggcctacgtagggtttactaatcgacttcctctgctccaagtctggcaaacacggcctccctgaccatcnctggctcgagtcngagacgagctctctattatgacagtctcatataacaagctaatatctagttgggtgttaacgggcggagggtaccgacttggccggttacttagggcaaggcccctaagggctccgttccccgtcgggttctaacccg

SEQ ID NO: 307391 - DNA, 507 bp, Homo sapiens
  misc_feature: GZ8MTXP01CSWVP.39.13.B02.1.454.CMB.2.raw
  modified_base (221)..(221): a, c, t, g, unknown or other
  misc_feature (221)..(221): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccngcagtgacgttggtgttataacatgtctctgtaccaacatcaccaggcaaagtcccaaactgatgattatgagtcactaaaacggccctacgagggtttcaaatcgacttcctctggctccaagtctgcaacacgcctccctgaccatcnctggctccaggctgagacgaggctntctattattgcagctcatanacaagnatatntactggtgtcggtcggaggacgacgtcgcgttcgttacggttcgaagaccaacggcgtcgcccctccggttccgtaaccc

SEQ ID NO: 307392 - DNA, 566 bp, Homo sapiens
  misc_feature: GZ8MTXP01EGRIZ.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggtaccaacatcacccaggcaaacgtccccaaactgatgtatttatgagtcaactaaacggccctcgtagggtttctaatcgcttcctctggctccaagtctggcaacacggccctccctgaccatctctggctccgagctgacggacgaggctctcttatacttgcagtctacatataacaagcctaattctctacgttgggtgttcggggcggacggggacccgttaccgtggtacccgttcgtttacggccgaacggtaccccgaaaggtccctccggttccccccgttcgggttcccttaaccccg

SEQ ID NO: 307393 - DNA, 559 bp, Homo sapiens
  misc_feature: GZ8MTXP01C8EB6.39.13.B02.1.454.CMB.2.raw
  modified_base (355)..(355): a, c, t, g, unknown or other
  misc_feature (355)..(355): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcacatctctgcactggaaccagcagtgacgttggtgttataactatgtctcttggtaccaacatcacccaggcaaagtccccaaactgatgatttatgagtcactaaacgcctcagggtttctaatcgcttcctctggctccaagtctgctaacncggcctccctcgaccatctctgggctcgagctgaggacgaggctctctattattgcagctcatatacaagctattactcgtacttggggtgttcgggcgggttaacggggtacccgaccgttacggacccgtttcgtttaacgggttcgaaccgtaccccgaagggtccctccgggttccccccttcgggttccgttaaccccg

SEQ ID NO: 307394 - DNA, 590 bp, Homo sapiens
  misc_feature: GZ8MTXP01ATEP1.39.13.B02.1.454.CMB.2.raw
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (565)..(565): a, c, t, g, unknown or other
  misc_feature (565)..(565): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccgagggaagggctggagtgggtctcatccattagtggtnccagtggtggtaatacatattatgtggactccgtgaagggccgttcaccatcnccagagacaattccaaagaacactctgtatctgaccaaatgaaacagcctgagcgcgaggaccacggcctatattactgtgacgaaatctcccgtacttacgtacggtttcgaccaacctaaactttcgacgtccgtcgggggggcccgaacggggtaaccctcggtccaccgtcctcctacacgccctaccacccgaacgggccctacgttccggtcccttccccgtcggccacgttcccttcctaacccaagcnccacccgttcgtcgggggcaaccgg

SEQ ID NO: 307395 - DNA, 530 bp, Homo sapiens
  misc_feature: GZ8MTXP01D6JQH.39.13.B02.1.454.CMB.2.raw
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttgtaccaacatcacccaggcaaagtccccaaactgatgatttatgagtcactaacgcctnagggtttcaatcgcttcnctgctcaagtctgcacacggcctccctgaccatctctggctcgagctgagacgagctctctattatgcagtctacatanacagctattatntacgttgggtgttcgggcgggttacgggacccgttacgtcgtaccggttcgttcgggttcaacggacccgtaagggtccctccggccccctcgggttcctaacccg

SEQ ID NO: 307396 - DNA, 586 bp, Homo sapiens
  misc_feature: GZ8MTXP01CJS2K.39.13.B02.1.454.CMB.2.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (382)..(382): a, c, t, g, unknown or other
  misc_feature (382)..(382): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttgaccaacatccaccaggacaaacgtccccaaactgatgtatttagngaggtcacgtaaaccggccctagtagggtttctaatcgtcttcctcgtggctaccaagtctggcaacgaccggccctccncgaccatcctcgtcgggcctcgaggcgtaggaggtacgaggtctctcttattagttgcagtctacaataataccaagtctaattactctacggtttgggtcggttcgggcgggttacgggtacccgttacgtacggtaccgttacgttcggttaccaacgtacccgaacggccgttaccggcccccgttcggttccttaacccg

SEQ ID NO: 307397 - DNA, 552 bp, Homo sapiens
  misc_feature: GZ8MTXP01A788A.39.13.B02.1.454.CMB.2.raw
  modified_base (224)..(224): a, c, t, g, unknown or other
  misc_feature (224)..(224): n is a, c, g, or t
  modified_base (362)..(362): a, c, t, g, unknown or other
  misc_feature (362)..(362): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttaataactatgtctcttggaccaacatcacccaggcaaacgtccccaaactgatgatttatgaggtcactaaacggcctcgtagggtttctaatcgcttcctctggctcagtctggcaacncgccctcctgaccatctctgggctccgaggcctggacggacgaggctcttctattattgcagtctnactaatacaanctaattactgtacgttggggtggttcgggcgggacggggtacccgaccgtggaacccgttcgttacgggttcaacggccaacgggcctcggcccccgttcggttccctaaccg

SEQ ID NO: 307398 - DNA, 576 bp, Homo sapiens
  misc_feature: GZ8MTXP01BBC9R.39.13.B02.1.454.CMB.2.raw
  modified_base (226)..(226): a, c, t, g, unknown or other
  misc_feature (226)..(226): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtagttataactatgtctcttgaccaacatcacccaggcaaacgtccccaaactgatgtatttatgaggtacaactaaaccggccctacgtagggtttctaagtcgtctttcctctggctaccaagtctcggcaacgaccggccctcccctgaccatctcgtgggcctccgagggctggacggacgagcttctactattatgctagtctcaattacaacgatctatatcagttcgggtagttcgggacggagggacccgttacgtacgtaccgttacgttcggttaccaacggacccgaacggtccgtcccgttcccccgtaacggttcctaaccccg

SEQ ID NO: 307399 - DNA, 543 bp, Homo sapiens
  misc_feature: GZ8MTXP01BP0AC.39.13.B02.1.454.CMB.2.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
  modified_base (432)..(432): a, c, t, g, unknown or other
  misc_feature (432)..(432): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccatctcctgcactggaaccngcagtgacgttggtagttaataactatgtctcttggtaccaacatcacccaggcaaacgtccccaaatgatgatttangagtcaactaaacggcctacgtagggtttctaatcgcttcctctgctcaagtctggcaacacggccctcctgaccatctctgggctcaggctggaaggcgagctctctattattgcagcttacatatacaanctaattactctagttgggtgttcgggcgggacgggtacccgaacgtcggtacccgttcgtttaacgggcaacggccccgaaggtcctcggccccctgggttccctaacccg

SEQ ID NO: 307400 - DNA, 608 bp, Homo sapiens
  misc_feature: GZ8MTXP01AGPH7.39.13.B02.1.454.CMB.2.raw
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtagttaataactatgtctcttaggaccaacatccaccaggacaaacgtccccaaatgatgtatttangagtacacgtaacggcctacgtagggttactaatcgtcttcctctgctcaagtctgcaacnccggcctcccngaccattcctctagtacctcgaggctaggaggacgaggctagacttattattgcgagctcaatactactgaagtcaattggtactccgtacgtggtacgttgggttaccggggacgggtaaaccgggtaacccgttaaagggtttcccggaaccccgggttaaccggtaacgggttcccgaacccggtaccccggttaaccgggtcccgttaaccccggttcccccccggg

SEQ ID NO: 307401 - DNA, 564 bp, Homo sapiens
  misc_feature: GZ8MTXP01AU0TA.39.13.B02.1.454.CMB.2.raw
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctctgacanatcaccaggacaaacgtcccaaatgatgattangagtcacgtaaacgcctgtagggtttacaatcgtcttcctctggctacagtctggcaacncggcctccctgaccatctctcggcctcgaggctaggaggacgaggcttctactattattcgactacgctacataactaacaacgtctaattactaccgtacgtttggggtcggtcgggacgggacggggaccgttaccgtacggcccgttacgtttacggcctaacggtccccgaaggtccctccgggttccccctggttccctaaccccg

SEQ ID NO: 307402 - DNA, 559 bp, Homo sapiens
  misc_feature: GZ8MTXP01AIT71.39.13.B02.1.454.CMB.2.raw
  modified_base (264)..(264): a, c, t, g, unknown or other
  misc_feature (264)..(264): n is a, c, g, or t
  modified_base (442)..(442): a, c, t, g, unknown or other
  misc_feature (442)..(442): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcttggaccaanatccacccaggaccaaacgtccccaaatgatgtatttatgagtacactaaaccggcctagtagggtttacaatcgtcttcctctcggctaccagtctggcaacgacccggtcctccctgacctatcctcgtgggcctcgaggctggacggacgaggctctcttattattgcagtctanatatacagtctattactcgtacggttgggtggttcgggcgggttacgggacccgttcgtacgtaccgttgttacggctaacgcccgaacggcctccgccccgttcgttccgtaaccg

SEQ ID NO: 307403 - DNA, 546 bp, Homo sapiens
  misc_feature: GZ8MTXP01AI4PI.39.13.B02.1.454.CMB.2.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (368)..(368): a, c, t, g, unknown or other
  misc_feature (368)..(368): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctggtccaanagcattcaggcagcgaccccgaaatctttaaatttatgaggttctttcgtcggcccttcgtagggggtttctagtcgtcttccgtccggctccaagtctggcaacncggccctaccctgaccatctctacgactccaggctgagacgagctagacttatattgcaggctcatatactgtaattcaattgtactccactggtctggttcgggcggagggtacctaagttcggccgttccgtaagggtaccaacggcccgaagggttccttccggcccccgttcgg

SEQ ID NO: 307404 - DNA, 503 bp, Homo sapiens
  misc_feature: GZ8MTXP01A31I5.39.13.B02.1.454.CMB.2.raw
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (432)..(432): a, c, t, g, unknown or other
  misc_feature (432)..(432): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccngcagtgacgttggtgttataactatgtctcttggtaccaacatcacccaggcaaagtccccaaactgatgatttangaggtcactaaacgccctgaggggtttcaatcgcttctctggctccagtctggcaaacncggcctcctgaccatcnctcgggctccgaggcctgaggacgaggctctcttattattgcagctcatatacanacatatcactggtgttcggcggaggacgcgtcgacgttcgttcgttcncgccaacgcncgccctcgcgtcc

SEQ ID NO: 307405 - DNA, 518 bp, Homo sapiens
  misc_feature: GZ8MTXP01AGSOA.39.13.B02.1.454.CMB.2.raw
  modified_base (225)..(225): a, c, t, g, unknown or other
  misc_feature (225)..(225): n is a, c, g, or t
  modified_base (450)..(450): a, c, t, g, unknown or other
  misc_feature (450)..(450): n is a, c, g, or t
tcagtcgcactagtcacgaccggtgctcgatttagtctagcgacttccgcgggggggttcgtcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataactatgtctcttggtaccaacatcacccaggcaaagtccccaaatgatgatttatgaggtcataaacggcctcagggggtttctaaatcgcttcctactggctcccaagtcttggcaacaacggcctccctgaccatctctgggctcaggctgaggacaggctctctatattgcagctcatatacaagcattatctacttgggtnttcgggcggaggggtaccaacgttgacccgttgttgggcaagcccaaggctcgcccctggttctaacg

SEQ ID NO: 307406 - DNA, 531 bp, Homo sapiens
  misc_feature: GZ8MTXP01AMIX4.39.13.B02.1.454.CMB.2.raw
  modified_base (320)..(320): a, c, t, g, unknown or other
  misc_feature (320)..(320): n is a, c, g, or t
  modified_base (470)..(470): a, c, t, g, unknown or other
  misc_feature (470)..(470): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaacggccctnaggggtttctaatcgcttctctggctcccaagtctggcaacacgggcctccctgaccatctctgggctccagggctgaggacgaggctctctattattgcagcttcatatacaagcattatctacttgggtgttcggcgggagggacccncgtgtaaccgttcgtttagggcaaggccccaagggcctcggccccctcgggttcctaaccg

SEQ ID NO: 307407 - DNA, 556 bp, Homo sapiens
  misc_feature: GZ8MTXP01D6GJY.39.13.B02.1.454.CMB.2.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (411)..(411): a, c, t, g, unknown or other
  misc_feature (411)..(411): n is a, c, g, or t
  modified_base (451)..(451): a, c, t, g, unknown or other
  misc_feature (451)..(451): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttataactatgtctcttgaccaanatcacccaggacaaacgtccccaaatgatgtatttatgaggtcaacgtaaaccgcctagtagggtttactaatcgtcttcctctgctccaagtctgcaacgccgtccctccctgacctatctcgtggctccgaggctagaggacgngtctctctattattgcgagtctacatatacaatctaattntctacgttgggtgttaacgggcggagggacccttcgtacgtaccggttacgtttacggccgaacgcccgaaggtccctccggccccgttcggttcccttaacccg

SEQ ID NO: 307408 - DNA, 580 bp, Homo sapiens
  misc_feature: GZ8MTXP01CT9P9.39.13.B02.1.454.CMB.2.raw
  modified_base (575)..(575): a, c, t, g, unknown or other
  misc_feature (575)..(575): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagcggggggggtccctgagactctcctgtacagtctctggattcagctttagcacctatgccatgagctggggtccgccaggctccgaggggaaggggctgggagtgggtctcatccattagtggtgccagtggtggtaatacatattatgtggactccggtgaagggccgttcaccatctccagagacaattccaaagaacactctgtaatctagaccaaatgaacagccctgagccgccgaagggacacggccctatacttactgtgcgaaactctcccgacttagtaggtttcgaccacctaactttcgacgtccgtcggggggccgacggggtaccctcggtccaccgtcctcctcacgtccctaccaccgacggcccacgttccggtccttccccgtcggccaccccttccttccaacgacgcacctcgttcggggcncgcgg

SEQ ID NO: 307409 - DNA, 639 bp, Homo sapiens
  misc_feature: GZ8MTXP01CPISI.39.13.B02.1.454.CMB.2.raw
  modified_base (264)..(264): a, c, t, g, unknown or other
  misc_feature (264)..(264): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttgggtagttataactatgtctcttgacaanatcaccaggacaaacgtaccccaaactgatgtatttatgaggtcaacgtaaaccggcctacgtagggtttctaatcgtcttcctctggctaccaagtctgccaacacccggcctccctagacctatcctactagacctccgaggcctaggaaggacgaggctaggtaaccttagttaagttcggactacgtaccttactaacgttaactacgtagtaacggtactaaagttggtaactaccctagttcgggtcgttcgggttccggggacgggtaaaccggggaccgttaaacgggttccggttaccccggttaacgtaaccgggttaaccgacccgggacccgttaaccgggtccgttcccccggtccccccgg

SEQ ID NO: 307410 - DNA, 551 bp, Homo sapiens
  misc_feature: GZ8MTXP01EKQXL.39.13.B02.1.454.CMB.2.raw
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggacaaacgtccccaaatgatgtatttatgagtcaactaaacggccctcgtagggtttcaatcgtcttctctgctcagtctggcacacgccctccngaccatctcgtggctccgagctggaggacgagctctcttattatgcngtctacatatacaatactattactctagtttggggtcggttcgggcggttacggggacccaccgtcggtacccgttcgtttacggctaacggacccgaacggtcccgtcccgccccgttcggttccttaacccg

SEQ ID NO: 307411 - DNA, 547 bp, Homo sapiens
  misc_feature: GZ8MTXP01EWVF3.39.13.B02.1.454.CMB.2.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcactggaaccagcagtgacgttggtgttaatactatgtctcttgaccaanatcacccaggcaaagtccccaaactgatnatttatgagtacactaaacgcctgtagggtttctaagtcgtcttcctctggctccaagtctggcaacgccggccctccctagaccatctcgtgggctccaggctggacggacgaggctctctagttatgcagctacaatactacaagtctattctcgtacgttgggtcggttcgggcggggttacggaccgttaccgtgaaccgttcgttacggttcaacgcccgtaacggctccgacccctcggttctaacccg

SEQ ID NO: 307412 - DNA, 573 bp, Homo sapiens
  misc_feature: GZ8MTXP01BH4YS.39.13.B02.1.454.CMB.2.raw
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (355)..(355): a, c, t, g, unknown or other
  misc_feature (355)..(355): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacatctctgcactggaaccngcagtgacgttggtgttatactatgtctntgacaacatcaccaggacaaacgtccccaaatgatgattatgagtcactaaacgcctgagggtttcaatcgtcttctctggctcaagtctgcacgacggcctccngacatctcgtggcctcgaggctggacggacgaggcttcgtcttaattattcggactacgtctactattaataacacgtactaattatctaacgttgggttcgttcggggcggttaacggggtacccgttaccgtcggtacccgttcggttacggttaccgtaacggtaccccgtaaggtccccgtaccggttcccccgtcgggttaacccttaacccg

SEQ ID NO: 307413 - DNA, 731 bp, Homo sapiens
  misc_feature: GZ8MTXP01ECIJ0.39.13.B02.1.454.CMB.2.raw
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcactatcctcctgcactcggaaccngcagtgtacgttggtagttaataactatgtctntagaccaacactccaaccaggaccaaacgtaccccaaatgatntatttatagagtacaacgtaaaccggtccctaggtacggtttactaagtcgtcttcctctggctccgaagtcgtacggaaccaaaccgacccggtccctcccgtacgaaccctcgttccctcggttacggggtcctacccggaaggtccgttacgggaacggggttacgaacgggttcccttacggttaccttaagttttaacgttcggaccgtaagtacccttactaaattaaacttaaacgaaacgttaccttaaattttacgtacccgtttaagggttttcgggggtcggtttaaccgggggacgggggttaaacccgggttacccgttacccgttaacgggtaacccgtttcggttacggttaccgaaccgtacccggaacgtcccggtacccgttcccccggttaacggttcctttaaccccgg

SEQ ID NO: 307414 - DNA, 507 bp, Homo sapiens
  misc_feature: GZ8MTXP01AOKUJ.39.13.B02.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacggggacctgggcccagtctgccctgactcagcctgcctccgtgtctgggtctcctggacagtcgatcaccatctcctgcactggaaccngcagtgacgttggtgttanactatgtctcttggtaccaacatcacccaggcaaagtccccaaactgatgatttangaggtcactaaacggccctntagggggtttctaatcgcttctcctggctccaagtctaggcaacacggcctccctgaccatctctcgggctccgaggctggaggacgaggctctctattatgcaggctcatatacaagcagcagcactcttgtgtattcggcggaggaccaagcttgaccgtcaggtcacgccaggtcttcgcccccg

SEQ ID NO: 307415 - DNA, 517 bp, Homo sapiens
  misc_feature: GZ8MTXP01B8Z6Q.39.13.B02.1.454.CMB.2.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctcttggaccaacatcaccaggcaaagtccccaaatgatgatttangagtcactaaacggcctgtagggtttctaatcgcttctctgctccaagtctggcaacacgccctcctgaccatctctggctcgaggctggaggacgagctctctattatgcagtctcatatacaagctattatctacgttgggtgttcgggcggacgggaccgacgtcggacgttcgttaggttcaacgcccaacggcctcggcccctcggttcctaaccg

SEQ ID NO: 307416 - DNA, 558 bp, Homo sapiens
  misc_feature: GZ8MTXP01B6SVM.39.13.B02.1.454.CMB.2.raw
  modified_base (398)..(398): a, c, t, g, unknown or other
  misc_feature (398)..(398): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctcctgcactggaaccagcagtgacgttggtgttataactatgtctcttagaccaacatccaccaggacaaacgtccccaaatgatgtatttatgagtcactaacggcctgaggtttcatcgtcttcctctgctcagtctgcacaccggcctccctgacctatcctcgtggcctccgaggctggacggacgnggtctctcttattattgctagtcttcattaacgaacaagtctaatttactcctacgtttggggtgttccggggacgggttacgggtaccgttaaccgtcgtaccgttcgtttacggctaacggaccctaaggcctccgttcccccgtcggttctaacccg

SEQ ID NO: 307417 - DNA, 579 bp, Homo sapiens
  misc_feature: GZ8MTXP01ETTPH.39.13.B02.1.454.CMB.2.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (365)..(365): a, c, t, g, unknown or other
  misc_feature (365)..(365): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtaggttataactatgtctcttggtaaccaanactcaacccaggacaaacgtccccaaatgatgatttatgagtacactaaacggcctacgagggtttcaatcgcttctctggctcaagtctgcaacnccggccctcctagaccatctcgtggctcgaggctgacggacgaggctctctattattgcagtctactataataacgaagtctaattactcgtacggtttgggttcggttcggggacggggacgggtacccgttccgtacggtaaccgttacgtttacggcgaaccggcccgtaaacggtcccgtaccggcccccgttcgggttcccttaacccg

SEQ ID NO: 307418 - DNA, 578 bp, Homo sapiens
  misc_feature: GZ8MTXP01C1JFJ.39.13.B02.1.454.CMB.2.raw
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (353)..(353): a, c, t, g, unknown or other
  misc_feature (353)..(353): n is a, c, g, or t
  modified_base (414)..(414): a, c, t, g, unknown or other
  misc_feature (414)..(414): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccngcagtgacgttggtgttatactatgtctctgacanatcaccaggcaaacgtcccaactgatgatttatgagtcacgtaaacggccctagtagggtttctaagtcgtcttctctgctcaagtctgcaacnccggcctcctgaccatctcgtgggcctcgaggcctggacggacgtagctctgtattatcgntacgctacatactaaccaagtctaattctaccgttagttcgggggttgttaacggggcgggttaacggggtacccgaccgttcggtacccgttacggttacggttaccgaacgtccccgaacggtcccgtcccggttccccccttcggggttaacccttccccg

SEQ ID NO: 307419 - DNA, 677 bp, Homo sapiens
  misc_feature: GZ8MTXP01AHWBX.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctctggaccaacatcaccaggaccaaacgtccccaaatgatgtaatttatgaggtaccaacgtaaaccggtccctacgtagggtttactaactcgtcttcctctggctccaagtctgggccaaaccgaccggtccctcccctagacccagttcctccgttcgggccttaccgagggtctagggacggggaacgtgggtccttacttactaactttagttggaccctaagtcccttactaaacttaacttaaaccgaaagtccttaaatttaaccgtcgttaaccgggttttggggggttcggtttccgggggacgggggaaaccgggtacccggacccgttacggtacccggtttacgttacggttaccgaacggtccccgaacgggtcccctccggttcccccgttccggttaaccgttcccg

SEQ ID NO: 307420 - DNA, 624 bp, Homo sapiens
  misc_feature: GZ8MTXP01DMX6C.39.13.B02.1.454.CMB.2.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcacatctctgcactggaaccngcagtgacgttggtgttataactatgtctcttgaccaanatcaccaggcaaacgtccccaaatnatgattangagtcactaaacgcctgaggtttcaatcgcttctctgctcaagtctggcaacaccggcctccctgaccatctcgtgcctcgaggctagggaggacggacggcttactcttaattactttcggactaagtcccttacaaacgtttaactaaccggaaagtacttaaactttacgttcgtaaccggtttgggggttcggtttaaccggggacggggaccggggtaaaccccgttaccgttacggaaccggtttaccgttaggggttacccgaacgggaaccccgtaaagggcccgttcccggccccccgttaacgggttccctttaaccccg

SEQ ID NO: 307421 - DNA, 560 bp, Homo sapiens
  misc_feature: GZ8MTXP01D0NM5.39.13.B02.1.454.CMB.2.raw
  modified_base (220)..(220): a, c, t, g, unknown or other
  misc_feature (220)..(220): n is a, c, g, or t
  modified_base (345)..(345): a, c, t, g, unknown or other
  misc_feature (345)..(345): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcacatctctgcactggaaccngcagtgacgttggtgttataactatgtctctggtacaacatcaccaggcaaagtccccaaactgatgatttatgagtcacgtaaacgcctgagggtttctaatcgtcttcctctggctcaagtcnggtcaaacaccgggccctccctcgacctatctccgtgggcctccgaggtctaggaacgggacagggtctactcctatttatgtcagtctcaatacaacaagctaatttatctaacgtttggggtggttcggcgggttaggggacccttacgtcggaccgttcgttcggttcgaacgacccgtaaggccttcgcccccgttcggttaaccgttccc

SEQ ID NO: 307422 - DNA, 545 bp, Homo sapiens
  misc_feature: GZ8MTXP01DVG3T.39.13.B02.1.454.CMB.2.raw
  modified_base (222)..(222): a, c, t, g, unknown or other
  misc_feature (222)..(222): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtcctctggacagtcgatcacatctctgcactggaaccngcagtgacgttggtgttatactatgtctcttgaccaacatcaccaggacaaacgtaccccaaatgatgtatttanagaggtcactaaacggtccctacgtagggtttctaatcgcttccnctgctacagtctgcacaccggcctccctgaccatctcgtcggtctccgnggctggaggacgaggctcttctattatgcagtctacaatanaacanactattntctacgttggtggttcggcgggacggtccgacgtcggtaccgttcgttacgcgaacgtcccgaacgggtccctccggttcccccgttcggttcctaacccg

SEQ ID NO: 307423 - DNA, 513 bp, Homo sapiens
  misc_feature: GZ8MTXP01BJDVX.39.13.B02.1.454.CMB.2.raw
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (347)..(347): a, c, t, g, unknown or other
  misc_feature (347)..(347): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttatactatgtctntggacaacatcaccaggacaaacgtcccaaatgatgattatgagtcactaacgcctcgtagggttctaatcgcttcctctgctcagtctggcacncgtcctcctgaccatctctggctcgagctgacgacgagctctctattattgcagctcatatacaagctaattatctagttcgggtgttcggcgggacgggaccgttacgtcggtaccgttcgttacgttcgaacggcccaaggtcctcgcccctcgggttcctccg

SEQ ID NO: 307424 - DNA, 650 bp, Homo sapiens
  misc_feature: GZ8MTXP01D3JGU.39.13.B02.1.454.CMB.2.raw
  modified_base (299)..(299): a, c, t, g, unknown or other
  misc_feature (299)..(299): n is a, c, g, or t
  modified_base (481)..(481): a, c, t, g, unknown or other
  misc_feature (481)..(481): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcacatctcctgcactggaaccagcagtgacgttgattgttatactatgtctcagtaccaacaaccacccggacaaacgccccgaagtcatgactttancgtacgtacactaacgtccggccctcgtaggggttctactaactccgtaccttctcgtggtacctaccgaaagttccgtcgggacctaaaccgtacccgggtcccctcccgtagaccctatccgtcgtcgggcctacgacggtcgtaggacggacgaggtacttagatttatactgggactncttacattactacaagtactaagttaactacgttcggtttcccgtttaacggggcggttaaacgggaaccgttaaacggtccgttaacggttacccgggttccgttaacgggtcccaccggaaccccgtaacggtcccgttcccggtaacccccgttcgggttaacccc

SEQ ID NO: 307425 - DNA, 541 bp, Homo sapiens
  misc_feature: GZ8MTXP01CI36E.39.13.B02.1.454.CMB.2.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (510)..(510): a, c, t, g, unknown or other
  misc_feature (510)..(510): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaaccngcagtgacgttggtgttatactatgtctcttggaccaacatcacccaggcaaacgtccccaaactgatgtatttangagtcaactaaacgccctcgagggtttctaatcgtcttcctctggctcaagtctggcaacaccggcctcctgaccatctcgtggcctcgagctgaggacgaggtcctctctaattattgcgngtctacattacaaccaagctaattntacgtacgttgggtgttaaccgggngggttacggacccgcgtacgtccgttcgttagttcncgaccgaagctcgcccctcggttcctaaccg

SEQ ID NO: 307426 - DNA, 579 bp, Homo sapiens
  misc_feature: GZ8MTXP01DZA21.39.13.B02.1.454.CMB.2.raw
  modified_base (221)..(221): a, c, t, g, unknown or other
  misc_feature (221)..(221): n is a, c, g, or t
  modified_base (433)..(433): a, c, t, g, unknown or other
  misc_feature (433)..(433): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcaccatctctgcactggaaccngcagtgacgttggtgttaataactatgtctcttgtaccaacatcacccaggacaaacgtaccccaaactgatgtatttatgagtcaactaaaccggccctacgtagggtttactaatcgtcttcctctaggctaccaagtctggcaacacggcctccctgacctatctcgtggctccgaggctagacggacgagctctctattattcgcganctacatataacaagtctaattactcgtacgttcgggtggttccgggcggttacggggacccttaccgttacggtacccgttacgtttagggacctaacggtccccgaacggtcccgtcccgttcccccgtccggttccctaacccg

SEQ ID NO: 307427 - DNA, 541 bp, Homo sapiens
  misc_feature: GZ8MTXP01AIX88.39.13.B02.1.454.CMB.2.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
  modified_base (386)..(386): a, c, t, g, unknown or other
  misc_feature (386)..(386): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttgaccaacatccacccaggacaaagtccccaaatgatgatttangaggtcacgtaaacggccctacgtagggtttctaatcgtcttcctctggctccaagtctggcaacaccggccctccctgaccatcnctggctcaggctgaggcgagctctctattattgcagtctacaatactacaaagctattactctaacgttgggtggttcggcgggttacgggacccgacgtcggtaaccgttcgttaggcaacggccgaaggcctccgcccccgtcggttcctccg

SEQ ID NO: 307428 - DNA, 573 bp, Homo sapiens
  misc_feature: GZ8MTXP01BHXIN.39.13.B02.1.454.CMB.2.raw
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (443)..(443): a, c, t, g, unknown or other
  misc_feature (443)..(443): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcacatctctgcactggaaccagcagtgacgttggtagttatactatgtctctgacaacatcaccagacaaacgtccccaaatgatgtatttangagtacaacgtaaaccggcctagtaggtttcaatcgtcttctctgctcagtctgcaacncgccctccctagacctatcctcgtcgggctccgagtcgtaggacggacgacgtcttacgtacttacttagttcgacacgtctacaattaanaacgtaaactctaatttactcgtacggtttgggtcggttaacggggcgggacgggtaccgacgtacgtacccgttacgttcggttacgaacgtcccgaagtcccgtccgttccccgtcggttctaacccg

SEQ ID NO: 307429 - DNA, 593 bp, Homo sapiens
  misc_feature: GZ8MTXP01BZR57.39.13.B02.1.454.CMB.2.raw
  modified_base (224)..(224): a, c, t, g, unknown or other
  misc_feature (224)..(224): n is a, c, g, or t
  modified_base (451)..(451): a, c, t, g, unknown or other
  misc_feature (451)..(451): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcactggaaccngcagtgacgttggtagttaataactatgtctcttggtaaccaacatccaacccaggacaaacgtccccaaactgatgatttatgagtcaactaaacggccctcgtaggggtttctaatcgcttcctctgctccaagtctgcaacacggccctccctgaccatctcgtgggcctccgaggctggaacggacgaggctctctaattattgcagctcaattactaacaanctaatttactccgtaagtttgggtcggttaacggggcgggttaacggggtacccgttaccgtacggtacccgttcgttacggacccgtaacgccccgaaaggggtccctcccggccccccgttcgggttaaccctttccccg

SEQ ID NO: 307430 - DNA, 794 bp, Homo sapiens
  misc_feature: GZ8MTXP01AUSTL.39.13.B02.1.454.CMB.2.raw
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccgaggggaaggggctggagtgggtctcatccattagtggtgccaggtggtggtaaatacatattatggtggactccggtgaacgggccgttcaccatctccagagacaattccaaagaacactctagtatctagaccaaatgaaacagccctaagacgccggaccgaacgggaccaccggtccctaagtattacctagtacgacgtaaactccgttaccccgtacgtttacggtacggttttaccgacccgtaacccttaaccgttttacggtaacccgttcccgggttaccgggggggggggtaccccgtaaaccggggggttaaaccccccgttcgggggttacccgtaaaccccggtttccccgttaccccttacccgacccggtacccccttaaccccgaaaccccggtaaacccgggggtaacccccctaacgtttccccggggttcccccttttaccccccccggccgggtacccccttaacccccccgttccccttaccccgtaaaccgggtaaccgccccgtaacccgtcccgggttaccggggggtaacccaacccgggaacccgggg

SEQ ID NO: 307431 - DNA, 701 bp, Homo sapiens
  misc_feature: GZ8MTXP01CS1AN.39.13.B02.1.454.CMB.2.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtagttataactatgtctcttgaccaacatcacccagacaaacgtcccaaactgatgtatttangaggtacactaaaccggccctagtagggtttacaatcgtcttcctcgtacggctaccaagttccgtcggccaaaccgaccgggtccctccctacgacctactcctccgtcgggcctcgacggtccgtaggaacgggaccggtaggtcccttacttacgttaagtttacgttcgacgtacgtccttactaacttaactaaaccgaaagtacttaaacgtttacgttaccgttaacggttttcgggggttcgggttaaccgggggtaaccgggggttaacgggggtaaccccgttaccggttaaccgggttaccccggttacggtttaccgggttacccgaaccgggtaccccgtaacgggtccccgtcccggttaccccccgttcgggttcccttaaccccg

SEQ ID NO: 307432 - DNA, 571 bp, Homo sapiens
  misc_feature: GZ8MTXP01B7RMI.39.13.B02.1.454.CMB.2.raw
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcttgaccaacatcaccagacaaacgtccccaatgatgtattatagagtacaacgtaaaccggccctacgtagggtttactaagtcgtcttcctcgtgctccaagtctggcaacgaccggccctccctgacccatctcgtgggcctcgnggctggaggacgagtctctctattatcgcagtctanataactacagactattactcgtagttcgggttggtcgggacgggacgggtacccgttacgtacggtacccgttcgttacggttccaacggacccgtaacggtccctccggcccccgttcgggttcctaaccccg

SEQ ID NO: 307433 - DNA, 555 bp, Homo sapiens
  misc_feature: GZ8MTXP01DLMD6.39.13.B02.1.454.CMB.2.raw
  modified_base (254)..(254): a, c, t, g, unknown or other
  misc_feature (254)..(254): n is a, c, g, or t
  modified_base (366)..(366): a, c, t, g, unknown or other
  misc_feature (366)..(366): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtgttataactatgtctnttgaccaacatcacccaggcaaacgtccccaaactgatgatttatgaggtacaactaaacggccctacgtagggtttctaatcgtcttcctcgtgctccaagtctggcaacnccggcctccctgaccatctcgtgggtctccgaggctggaggacgaggctctctattattgctagctacatatacaagctattactctacgttgggtggttcgggcgggacgggtaccgaccgtacgaccgttcgttcggttaccgaacgcccgaacggtcctccggttccccctggttcccttaacccg

SEQ ID NO: 307434 - DNA, 553 bp, Homo sapiens
  misc_feature: GZ8MTXP01DJWUH.39.13.B02.1.454.CMB.2.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (351)..(351): a, c, t, g, unknown or other
  misc_feature (351)..(351): n is a, c, g, or t
  modified_base (397)..(397): a, c, t, g, unknown or other
  misc_feature (397)..(397): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttaanaactatgtctcttggtaccaaacatcaacccaggcaaacgtccccaaactgatgatttatgaaggtcaactaaaccggcctcgagggtttctaaatcgctttccnctggctaccaagtctggcaacaccgggccctccctagaccatctcngggcctacgagggctagaggacgaggctctctattaagttgcagtctnatataacgatcaattatntacgttggggtgttcggcgggacgggtaccacgtacgtccgttacgttgggcaacggaccgtaaggcttccgcccctggttccttaaccg

SEQ ID NO: 307435 - DNA, 547 bp, Homo sapiens
  misc_feature: GZ8MTXP01CICKU.39.13.B02.1.454.CMB.2.raw
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccagcagtgacgttggtgttatactatgtctcttgaccacatcacccaggcaaagtccccaaatgatgattangagtcactaacgccctgaggtttcaatcgcttcctctgctccagtctggcacaccggcctccngaccatcctcgtgggcctcgaggctgaggacgaggcctcgtctattattgcgtagctacgatanacaagctaattntctacgtttggggtcgttccgggcgggacgggtacccgccgttacggacccgttcgttacggttccaaccggtaccccgaaggtccctccggcccccgttcggttcccttaacccg

SEQ ID NO: 307436 - DNA, 630 bp, Homo sapiens
  misc_feature: GZ8MTXP01CPZ6J.39.13.B02.1.454.CMB.2.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccatgactcagcctgcctcgtgtctggtctcctggacagtcgatcaccatctcctgcactggaaccngcagtgacgttggtagttatactatgtctctgaccaanactccaccaggacaaacgtccccaaatgatagatttangagtacaacgtaaaccggcctagtagggtttactaagtcgtaccttctacgtgtacctaccgaaagttccgtcggaccaaaccgacccggtcccctacccgtacgaccctacttcctcgtcgggcctccgaggtcgtacggacggacgacggtcttacgttacttaagttacgttcggacgtaagtcctacaattactaacgtagtaaagtctaaagttcggtaactccgtaacgtggttcgttagggttccgggaacgggtaacgggttacgttaggttccgtaacccgttacgtaacggtccacgacccgtaacgggttccctccccgg

SEQ ID NO: 307437 - DNA, 641 bp, Homo sapiens
  misc_feature: GZ8MTXP01CAUJ4.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctcttgacaacatccaccaggaccaaacgtaccccaaactgatgtaatttataggtaggtaccaacgtaaaccggtcccctacgtacgggggttttctaaacttcgtacctttcccgtcctgggtccttacccgtaaagttccttacgggccaaaccgaacccgggtccccttcccgtacgacccctatcccgttcgtcggggtcctccgaggtcttacggaacgggtacgaggtccttctacttattattcgacagtctacattaactaacgaatctaacttatctaaccgttggggtcgttccggggcggacggggtacccgacgtcggtaccgttcgttacggctaacggcccgaacggtcctccggttccccgtcggttaacctccg

SEQ ID NO: 307438 - DNA, 574 bp, Homo sapiens
  misc_feature: GZ8MTXP01BMPFN.39.13.B02.1.454.CMB.2.raw
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctggcccagtctgccctgactcagcctgcctccgtgtctggtctcctggacagtcgatcaccatctcctgcactggaaccngcagtgtacgttggtagttaataactatgtctcttggtaccaanatcaccaggacaaacgtccccaaactgatgtatttangaggtacaacgtaaaccgcctacgtagggtttactaatcgtcttcctctggctccaagtctgcaacgaccggcctccctgaccatctcgtgggcctcgagcgtgaacgggacgaggtctcttctattactgcagtctacataatacaagtctaattactctacgtttgggtcgttcgggcggacgggacccgacgttacggacccgttcgtttaacggccaacggacccgtaacggccgtcccggttcccccgtcgggttaaccttcccg

SEQ ID NO: 307439 - DNA, 724 bp, Homo sapiens
  misc_feature: GZ8MTXP01CU9J9.39.13.B02.1.454.CMB.2.raw
tcagtcgcactagtcacgaccggtgctcgatttagtctagcgactttgggctgagctgcctttttcttgtggctatgttaaaaggtgtccagtgtgaggtgcagctgttggagtcgtggggggaggcttggtacgaggcggggggggtcctgagactctcctgtacagtctctggattcagtctttagcacctatgccatgagcgtggtccgcgaggctccggaggggaagggcgtggaggtggtctcatccgtagttaggtggtgcgtaggtggtagtaactatatattgtggtggactcggtagaacggtccgttacacctatcacgaagaacgacaaacttaccaaagaacacttcttagtactactagaaaccaaatacgaacacgcctaaggacgccgaccgggaaacgaccgtaaccggtacccttaagttacttaccgtagtacgtaaaccgtaaacttcccgtaccgttaacgttacggttaacgtttccgacccttaaacttaacgttcgaaccgtccggtacggggggacccgtaacggggtacctcggtacccgtcccgtacctcccgttacgaccggtcccctaacccgaaccggtacccgggtcccctacgttccccgggttccccttccccggtaccgaccccttaccccgttcaaccccgaacggaccgtcccgtacccgtcggggaccggggtccaacggtcccgggg

SEQ ID NO: 307440 - DNA, 544 bp, Homo sapiens
  misc_feature: GZ8MTXP01DKXZ1.39.13.B02.1.454.CMB.2.raw
  modified_base (222)..(222): a, c, t, g, unknown or other
  misc_feature (222)..(222): n is a, c, g, or t
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctctgcactggaaccngcagtgacgttggtgttataactatgtctcttgtaccaacatcaccaggcaaagtccccaaatgatgatttangagtcactaaacggcctcgagggtttctaatcgcttctctgctcagtctggcaaacacggcctcccngaccatcctctgggctccaggctggaggcgaggctctctattattgcgtagctacattataccaagtctattactctacgttgggtggttcgggcgggttacgggacccgttacgtcgtaaccgttcgttaggttaccaacgtcccgaaggtcctcggttccccctaacgggttccttcccg

SEQ ID NO: 307441 - DNA, 582 bp, Homo sapiens
  misc_feature: GZ8MTXP01CH2WH.39.13.B02.1.454.CMB.2.raw
tcagtcgcactagtcacgaccggtgctcgatttagtctagcgacttccggcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctgacacatcacccaggcaaacgtccccaaatgatgatttatgaggtacactaaacggccctcgtagggtttactaatcgtcttcctctgctcaagtctcgcaacacggcctcctgacctatctcgtcgggctccgacggcgtaggacggacgtaggtcctcgttctattattcgcagtctactaatataccgaagtctaattatcctaggttcggggttaggttccgggcggggttacgggacccgttaccgttacggtaccggttcgttacgggttccaacggacccgtaacggccgtcccggaccccgttcggttaacctcccg

SEQ ID NO: 307442 - DNA, 579 bp, Homo sapiens
  misc_feature: GZ8MTXP01EX96P.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataactatgtctcttggtaccaacatcacccaggacaaacgtccccaaactcatcatttatgagtcagtaatcggcctcgtagggtttctaatcgtccttctctggctccaaagtctgacaacacggcctcctgaccatctcgtggctcgaggctagaggacgaggctgtattagttactggctagtcttactatttcgactaatcgtaggtgaggtctttaagtcgttacgtttcgggaaaggttcgggaaaccgtaagggttccgttacgttcccggttaaccgtagggttaacccaacggtaccccgaacgggaaccccttaaaccccgtaaccg

SEQ ID NO: 307443 - DNA, 562 bp, Homo sapiens
  misc_feature: GZ8MTXP01EZBF7.39.13.B02.1.454.CMB.2.raw
  modified_base (224)..(224): a, c, t, g, unknown or other
  misc_feature (224)..(224): n is a, c, g, or t
  modified_base (355)..(355): a, c, t, g, unknown or other
  misc_feature (355)..(355): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtggttatactatgtctcttgaccaacatcacccaggacaaacgtaccccaaatgatgtatttatgagtcactaaaccggccttcgagggtttactaatcgtcttcctctgctcagtcngcacgacggccctcctcgaccatctcgtcggctcgagctagaggacgacggctctctacttatgcagtctactatataaccaagtacttatttactacgttaccgttggggttggttcgggcgggttaccgggaccgttaccgtcggtaccgttcgttaggttcaacggaccgtaacggccttaccggccccttccgggttctcccg

SEQ ID NO: 307444 - DNA, 539 bp, Homo sapiens
  misc_feature: GZ8MTXP01A8LL2.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctcttggtaccaacatcacccaggcaaagtccccaaactgatgtatttatgaggtcactaaaccggcctcgaggggtttctaatcgcttcctctgctcaagtctggcaacacggcctcctgaccatctcgtggcctcgaggctggaggtacgaggtctactctagttattgcagtctcatatacaagtcattatctattggggtgttcggcgggagggacccgccgtacggtaccgttacgtttacgggcaacggccctaaggcctaccgccccttcggttcctaacccg

SEQ ID NO: 307445 - DNA, 544 bp, Homo sapiens
  misc_feature: GZ8MTXP01BAEFS.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggtaccaacatcacccaggcaaacgtccccaaatgatgatttatgaggtcaactaaacggccctagagggtttctaatcgcttcctctggctccaagtctggcaacacggcctcctgaccatctctggctcaggctgaggacgagctctctattattgcagctacatataacaagctaattatctacgtttgggtgttcgggcgggacggggacccgaccgtcggtaccgttcgtttacgttccgaacgtcccgaacggtcctccggccccctcgggttcctaacccg

SEQ ID NO: 307446 - DNA, 654 bp, Homo sapiens
  misc_feature: GZ8MTXP01CJFFJ.39.13.B02.1.454.CMB.2.raw
  modified_base (224)..(224): a, c, t, g, unknown or other
  misc_feature (224)..(224): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
tcagtcgcactagtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccngcagtgacgttggtagttatactatgtctctagacaanatcaccaggacaaacgtcccaatgatgtattanagagtacacgtaaacgtcctagtaggttctaatcgtcttcctcgtgctaccaagtcgacgtccaaacgacccggtaccctccccgtacgaacccgtattcccgtcgtcgggtcctacccggaggtccgttaggaacgggtaaccggtcggtccttacttacttaagtttaagtcggactacgtactactaaagttaactaaccgaaagtcttaaagttactacgttacggtttcggggttcggttaacgggacgggaacgggtacccgttaaccgttcggtaccgttacgttacgggttaccgtaaccggacccgtaacggtcccgacccgttacccccgttcggttccctttaacccg

SEQ ID NO: 307447 - DNA, 628 bp, Homo sapiens
  misc_feature: GZ8MTXP01AEQK1.39.13.B02.1.454.CMB.2.raw
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaaccngcagtgtacgttggtagttaataactatgtctcttgacaanacnccaccagacaacgtacccaatgtatntattangagtacaacgtaaccgtcctacgtaggttactacgtcgtcttcctcgtgtctacagtcgtacgaacaacgccgtcctcctacgacctactctcgtcggtcctacgagcgtaggacggacgacgtctacgtacttaagttagttcgacgtacgtacctactaaactaactaacgtacgtacttaaattactcgttaacggttggggttcggttaacggggacggggttacgggtacccgttaccggttacggtacccggttacgttcggttaccgaaccggtacccgtaacggtcccgtcccgttaccccggttcggttccgtaacccg

SEQ ID NO: 307448 - DNA, 558 bp, Homo sapiens
  misc_feature: GZ8MTXP01DNZFB.39.13.B02.1.454.CMB.2.raw
  modified_base (291)..(291): a, c, t, g, unknown or other
  misc_feature (291)..(291): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcactggaaccagcagtgacgttggtagttataactatgtctcttgaccaacactcaccaggacaaacgtccccaaatnatgtattatgagtacactaaacgcctagtagggtttctaatcgtctctctgctcagtctgcaacacgccctccacgacatctcgtcggctccgaggctaggacggacgtacggtcttcgtcttattacgttgactagcttacaatactaacgatactattatctaggttgggtcgttcgggcgggacggacgttccgtaggtacccgttagttcgacgtaacgacccgaacgggtcctcccgttacccccgtcggttccctaacccg

SEQ ID NO: 307449 - DNA, 553 bp, Homo sapiens
  misc_feature: GZ8MTXP01EE8TC.39.13.B02.1.454.CMB.2.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtntcttataattatgtctctggtccaacngcattcgaggcacgccgaccccgtaaattcttaaatttatgtaggttctttcggtcggccctgtagggtttcagtcgtcttctcggctccagtctggccacgaccggccctccccgtgaccctattcctactacgacctccgaggcctagggaacggtaccggaggtctagaaccttattagttcgactagtcttctatttgacatcgaagtgtagtcttagtgtcgtagggagtcggacgtagtcttagttcgttcgtggtcaacgcccagcccaaccgttgtccg

SEQ ID NO: 307450 - DNA, 525 bp, Homo sapiens
  misc_feature: GZ8MTXP01BKNI9.39.13.B02.1.454.CMB.2.raw
  modified_base (221)..(221): a, c, t, g, unknown or other
  misc_feature (221)..(221): n is a, c, g, or t
  modified_base (398)..(398): a, c, t, g, unknown or other
  misc_feature (398)..(398): n is a, c, g, or t
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttaataactatgtctcttggtaccaacatcacccaggcaaagtccccaaatgatgatttatgaggtcactaaacggccctcgagggtttctaatcgcttcctctggctcaagtctgcaacacggcctccctgaccatctctgggctccagctgaggcgagcnctctattattgcagctcatatacagcattatcagttggtgttcggcgggagggtaccgaccgtggtaacccgttcgttacgggttcaagtcccgaaagggcctcggccccctcgggttccgtaaccc

SEQ ID NO: 307451 - DNA, 707 bp, Homo sapiens
  misc_feature: GZ8MTXP01ESCP3.39.13.B02.1.454.CMB.2.raw
  modified_base (208)..(208): a, c, t, g, unknown or other
  misc_feature (208)..(208): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagcggggggggtccctgagactctcctgtacagtctctggattcagctttagcacctatgccatgagctgggtccnccaggctccgaggggaaggggctggagtgggtctcatccattagtggtgccaggtggtaggtaaatacgtatatagtggtacgtaccgtcggtaggaccgggtcctaccactctccacgaagacgaactaactaacgaaacgaactctgtagtactcgacaaactagtaaacacgaccgtcgaacggccgccggacgtaacgaccgacccgtattattacgtcgtagacgtaaactacctccgtaccgttagttacggttcgttaccacccttaaacgttacgtaccgtaccgttccggggaccgggacgggtaaaccccgttccggtacccgtacccgtacctccctacctaccgccctcccaaccccgaaccggacccgtaaccttcccgggttccccgttccccccgttccggaccctaacccccttcccttacccgaaaccgaacgggccctaacccgtaccgggtcggggaccgaaccgaaccgggtccccggg

SEQ ID NO: 307452 - DNA, 662 bp, Homo sapiens
  misc_feature: GZ8MTXP01CRDWO.39.13.B02.1.454.CMB.2.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgccctccgtgtctgggtctcctggacagtcgatcacatctctgcactggaaccngcagtgacgttggtagttataactntgtctcttaggaccaacatccaccaggacaaacgtaccccaaatgatgtaatttangaggtacacgtaaaccggccctcgtagggtttctaactcgtcttcctcgtgctccaagtctcgcaacgacgccctcctacgaccatcctcgtggcctacgagcgtggacggacgtacggtctacgttactagtttattcgcgtacgtcctactaattaacttaacaacgtacttaaactttactccgttaacggtttcgggggtttcggttcccgggggaacggggttaaccgggggtaaccccgttaccggttaccggtaccccgggtttacgtttaacgggcccgtaacccgggtaccccgtaacggggtcccttccccggttaccccccgttccgggttaacccttaaccccgg

SEQ ID NO: 307453 - DNA, 644 bp, Homo sapiens
  misc_feature: GZ8MTXP01E0EIE.39.13.B02.1.454.CMB.2.raw
tcagtcgcactagtcacgaccggtgctcgatttagtctagcgactttgggctgagctgcctttttcttgtggctatgttaaaaaggtgtccagtgtgaggtgcagctgttggagtctggggggaggcttggtacaggcggggggggtccctgagactctcctgtacagtctctggattcagctttagcacctatgccatgagctgggtccgccaggctccgagggaaggggctggagtgggtctcatccattagtggtgccaggtggtggtaatacatattatgtggactccgtgaaggccgttcacatctccagagacaattccaaagaacactctgtatctgaccaaatgaacagcctagagcgccgaggacacggcctatattactgtgacgaaactctacccgtacttacggtacggtttcgaccctaacctaactttcgtaccgttcccggtacggggggggacccgtaaccggggtaacccgttcgggtaccacccgttccttccctaccaccgtcccctacccaacccgaacgggccccgtaacgttcccggttccctttcccccgttcggaccccttccccgttcccttacccgaacgccgcctacccgtcggcgggggtccgaacgaacccgggg

SEQ ID NO: 307454 - DNA, 582 bp, Homo sapiens
  misc_feature: GZ8MTXP01B7KXU.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcaggcacagggtcctgggcccagtctgccctgactcagcctgcctccgtgtctgggtctcctggacagtcgatcaccatctctgcactggaaccagcagtgacgttggtagttataactatgtctcttgtaccaacatcacccaggcaaagtccccaaactgatgatttatgaggtcactaaacgcctcgtagggttctaatcgtcttcctctgctccaagtctggcaacaccggccctcccgtgaccactctctgggctccgagctgacggtacgaggctctctaattattgcagtctcatataacagctaattatccgtaatttggggtcgtttcggggcggttacggggtacccgacgttaccggtccgttacgtttacgggttaccctaacggaccccgaaacgggtccccgtccggttacccccccttcggggttaaccctttcccccgg

SEQ ID NO: 307455 - DNA, 642 bp, Homo sapiens
  misc_feature: GZ8MTXP01DZRGL.39.13.B02.1.454.CMB.2.raw
  modified_base (221)..(221): a, c, t, g, unknown or other
  misc_feature (221)..(221): n is a, c, g, or t
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacatctctgcactggaaccngcagtgtacgttggtgttaatactatgtctctagacaanatcaccaggacaaacgtaccccaaatgatagtatttagngagtacaacgtaaaccgcctagtaggtttacaatcgtcttccgctgctactagtcagcaacgaccgtccctaccgtgacctattcctcgtgggacctcgaggtcgtaggaacgggacgtacggtccttacgtacttaatttacgttacgacgacgttcttaacaaagttactaaaaccgagttacttaaactttacgttacccgttaagggttttcggggtggttaacccgggggagggttaccgggtaacccgttaccgttacgggtaacccgtttacggttcgggacctaaccgggcccgaaacggttccgtacccgttccccgttcggttccttaacccg

SEQ ID NO: 307456 - DNA, 560 bp, Homo sapiens
  misc_feature: GZ8MTXP01BIUNE.39.13.B02.1.454.CMB.2.raw
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (428)..(428): a, c, t, g, unknown or other
  misc_feature (428)..(428): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtagttataactatgtctcttgaccaacatcaccaggacaaacgtcccaaatgatgatttangagtcactaaacggcctagtagggtttctaatcgtcttcctctggctcaagtctggcacacggcctcctgaccatcctcgtggcctcgaggctggacggacgtggctcgtctattatgcagtctacatanacagtctattctctagttcgggtagttcgggacgggacgggtaccgaccgtacgtacccggttacgttacggttaccgaacggtcccgtaacgggtcccgtccgttacccccgtaacggttcccttaacccg

SEQ ID NO: 307457 - DNA, 620 bp, Homo sapiens
  misc_feature: GZ8MTXP01AF4PO.39.13.B02.1.454.CMB.2.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcactggaaccagcagtgacgttggtagttanaacatgtctcttgacaacntcaccaggcaaacgtccccaatgatgtattatgagtcaactaacgcctgtaggttctaatcgtcttccnctcgctacagtctcggctaaccgccggtccctcccgtgacctctccgtcgtcgggcctcgagggccgtaggacggacgtacggtctacttcttaagttacttggactacgtaccttacctaaagttaaccgtaaacaaacgtacctaaagtttaaaccttccgtaacggtttcgggggttacggttcgggccggggttaacggggtacccgttaccgtcggaccggttcgtttacggcctaacggcccgtaacggtccctccggacccccgtttcggcccttaacccg

SEQ ID NO: 307458 - DNA, 553 bp, Homo sapiens
  misc_feature: GZ8MTXP01BHSFA.39.13.B02.1.454.CMB.2.raw
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacatctctgcactggaaccagcagtgtacgttggtagttataactatgtctcttggaccaacatcacccaggacaaacgtccccaaatgatgatttatgagtcactaacgcctacgtagggtttctaatcgtcttcctctcgctccaagtctggcaacaccggcctccctgaccatctctgggctcgaggctgaggcgaggctctatattattgcgagtctanaatatacaagctaattntctaacggtttgggtggtcgggcgggacgggacccgttacgtcggtaccgttcgttcggttacaaccggacccgtaaggccctccggttcccccgtcgggttccgtaacccg

SEQ ID NO: 307459 - DNA, 595 bp, Homo sapiens
  misc_feature: GZ8MTXP01CSSAV.39.13.B02.1.454.CMB.2.raw
  modified_base (225)..(225): a, c, t, g, unknown or other
  misc_feature (225)..(225): n is a, c, g, or t
  modified_base (300)..(300): a, c, t, g, unknown or other
  misc_feature (300)..(300): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgccctccgtgtctgggtctcctggacagtcgatcaccatctctgcactggaaccngcagtgacgttggtagttataactatgtctcttgtaccaacatcacccaggcaaacgtccccaaatgatgattangagtcactaaacgcctcgtagggttcaatcgcttctctgctcagtctgcacacgcctcctgaccatctcgtgggctcgaggctggacggtcgaggtctctcttattattcggactagcctacaacttaacttaacccaaagccttaatttaacttcgtaaccgttttgggggtcgtttaaccgggggcgggaacgggggtaccccgttaccgttacgggtacccggttcgttacgggttacctaacgggaccctaagggcccttccggaccccccgttcggttcccttaaccccg

SEQ ID NO: 307460 - DNA, 579 bp, Homo sapiens
  misc_feature: GZ8MTXP01BG5ZZ.39.13.B02.1.454.CMB.2.raw
  modified_base (225)..(225): a, c, t, g, unknown or other
  misc_feature (225)..(225): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgtacgttggtgttaatactatgtctcttgaccaacactcaccaggaccaaacgtaccccaatgatgtattatgagtcacgtaacgcctgtaggtttctatcgtcttctctgctcagtcngcacncgcctctcacntctcnggctcgngctggacggcgagtctctctagttatgcacgtctacaattaacaacaatactagttatcgttacggttggggttcggttcgggcggggttacgggtaccccgttaccggttacggtaacccggtttcgttacgggttaccgaacccgggaccccgtaacggtcccgttaccccggacccccgttccggttcccttaaccccg

SEQ ID NO: 307461 - DNA, 602 bp, Homo sapiens
  misc_feature: GZ8MTXP01EV4VX.39.13.B02.1.454.CMB.2.raw
  modified_base (221)..(221): a, c, t, g, unknown or other
  misc_feature (221)..(221): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacatctctgcactggaaccngcagtgacgttggtagttataactatgtctcttaggtaccaacactacacccaggacaaacgtccccaaactgatagtatttatgacgtacaacgtaaaccggcctacgtagggtttactaatcgtcttcctctgctcagtcagcacacgtcctcctagactatctctcggctccgagcgtaggacggacgtaggccttactacttattattcgactagtctactaactaataacgaacgtacttaacttactaccgtacgtttggggtcggttcggggcgggttaacgggacccgttaccgtacggttacccggttacgttacggttccgaaccggtaccgaaccggtccgtccccggccccgttccggttaacctcccg

SEQ ID NO: 307462 - DNA, 612 bp, Homo sapiens
  misc_feature: GZ8MTXP01AUCNT.39.13.B02.1.454.CMB.2.raw
  modified_base (266)..(266): a, c, t, g, unknown or other
  misc_feature (266)..(266): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtagttataactatgtctcttgaccaanatcaccaggacaaacgtaccccaaaatgatgtatttatgaggtacaccgtaaacggcccttagtacgggtttctaagtcgtacttcctctgcctaccaagtcctagggtcaaaccgaccggtccctaccctgaccctatcctcgtcggcctccgaggctagggaggacgaggtcctgttacttattattgcgtagtctanattaanacanatattatcgttacgttggggtcgttaacgggcgggacgggtaccttaccgtacggtacccgttcgttacgggttaccaacccgggtacccgtaacgggcccgtcccggttccccccgtaaggttccccttccccgg

SEQ ID NO: 307463 - DNA, 577 bp, Homo sapiens
  misc_feature: GZ8MTXP01CUVXS.39.13.B02.1.454.CMB.2.raw
  modified_base (223)..(223): a, c, t, g, unknown or other
  misc_feature (223)..(223): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccngcagtgacgttggtgttataactatgtctcttgtaccaacatcacccaggacaaacgtcccaaactgatgtatttatgagtcactaaaccggcctgagggtttcaatcgtcttctctggctcaagtctgcaacacgcctcctgactatctcgtggcctcgaggtctaggaggtacgaggtcctcttactattagttgacagtctaccaattataaccaaagtcttaaattactcgtacggtttagggtcggttcggtaccggttaggggaccccttacggttacgtcccggttcgtttacggttacgaacgaccccgtaaggccttccgcccccgttcggttccttaaccccgg

SEQ ID NO: 307464 - DNA, 570 bp, Homo sapiens
  misc_feature: GZ8MTXP01B077U.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagtctgcctcgtgtctgggtctcctggacagtcgatcaccatctcctgcactggaaccagcagtgacgttggtgttataactatgtctcttggtaccaacatcacccaggacaaagtccccaaatgatgatttatgagtcactaacggcctgtagggtttctaatcgtcttcctctggctccgagtctggcaacgaccggccctccctgacctatcctcgtcgggctccgaggctgacggacgaggctcgtctattattgcgtagtctacattaataccaagtcctaattactcgtacggtttggggtcggttcggggcgggacggggtcccgaccgtcggtacccgttcgttacgggttccaacggcccgaacggcctccggcccccgttcggttcctaacccg

SEQ ID NO: 307465 - DNA, 540 bp, Homo sapiens
  misc_feature: GZ8MTXP01C29FQ.39.13.B02.1.454.CMB.2.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttaataactatgtctcttggaccaacatcacccaggcaaacgtccccaaactnatgatttatgagtcactaaacggccctgagggtttctaatcgcttcctctggctcaagtctggcaacacggccctccctgacctatctntgggcctcaggctggaggacgagctcgtctattattgcagctnaatataacaagtctattatctacgttgggtggttcgggcggagggacccgcgtcggacccgttcgttggttccaacggccctaaggcccgtcgttacccccgtcggttcctcccg

SEQ ID NO: 307466 - DNA, 554 bp, Homo sapiens
  misc_feature: GZ8MTXP01CWIWG.39.13.B02.1.454.CMB.2.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccngcagtgacgttggtgttataactatgtctcttgaccaacatcaccagacaacgtacccaatnatgtattagngagtacacgtaaaccggccctgtagggttactaatcgtcttcctctgctccgtaagtcgtgccaaacgccggccctccctacgacctctcgtcgtcggacctcgaggctaggaaggacgaggtctagtattatacgtgctacgtctctatttgactatcgagtgtagtcttatgttaagtacggaggtcggaccgtaaaggtcttacgttcgacgttaagaccaaccgacccgacgttacccaaccccgttgtaaccg

SEQ ID NO: 307467 - DNA, 551 bp, Homo sapiens
  misc_feature: GZ8MTXP01DXVCD.39.13.B02.1.454.CMB.2.raw
  modified_base (265)..(265): a, c, t, g, unknown or other
  misc_feature (265)..(265): n is a, c, g, or t
  modified_base (459)..(459): a, c, t, g, unknown or other
  misc_feature (459)..(459): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtgttataactatgtctcttggtaccaanatcaacccaggacaaacgtccccaaatgatgatttatgaggtcacgtaaacggccctgtagggtttctaatcgcttctctgctcaagtctaggcaacaccggcctccctgaccatctctcgggctccgaggtcctagacggacgtacggctcttctaatttattcgctacgtctacattataacaatctaattntactcgttgggtgttcgggcggacgggaccgttacgtgtccgttacgttggccaacgtcccgaaggtccctcgccccgttcggcttaacccg

SEQ ID NO: 307468 - DNA, 556 bp, Homo sapiens
  misc_feature: GZ8MTXP01C16T9.39.13.B02.1.454.CMB.2.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
  modified_base (547)..(547): a, c, t, g, unknown or other
  misc_feature (547)..(547): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcatcacatctctgcactggaaccngcagtgacgttggtagttatactatgtctctgaccaanactcacccaggacaaacgtaccccaatgatgtatttatgagtacacgtaaaccggccctacgtagggtttactatcgtccttcctctggtctccaagtcctgcaacaccggccctccctcgacctatctcgtcgggcctccgaggtcgttaaggacgtaggtctctacttagttattgcaggtctacatactacaagctattactctacgttgggtcgttcgggcggacgggaccgacgttcggaccgttgttacggttcacgcccgaagctcccgcccttcggtccncgtttcccg

SEQ ID NO: 307469 - DNA, 759 bp, Homo sapiens
  misc_feature: GZ8MTXP01CXD94.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccctcctcactcagggcacgagggtcctgggcccagtctgccctgactcagcctgcctcgtgtcgtgggtctccgtggacagtcgatcaccatctctgcactaggaaccagctaggtgtacgttggtagttaataacgtattgtcttcttacggtaaccaactactccaacccgaggaccaaaaccgtccccaaagtgaatagtaatttagtacggtaacggtaccaaaccgttaaacccggtcccgtacggttaacgggggttttacctaaacgttccgtcctttacccgtccgtacgggtacccttaccgtaaacgtccgttacgggaacctaaacccgtcccgggtccccttacccgtacggaacctacgtccgttccgtcgggtcctacgacggtcgtagggaacgggtacgtacggtccttacgttacttaacgtttagttcgaccgtaacgtcttaacgtaaacttaaacttaaccgaaacgtactttaaacgttacgttaccgttaacgggttcggggttcggttaaccggggacgggttaaccggtacccgttacgtacggtaccgttacgttacggaccgtaaccggccgtaaccggtccgtacccggttcccccgttgttaacccgttcccg

SEQ ID NO: 307470 - DNA, 566 bp, Homo sapiens
  misc_feature: GZ8MTXP01A7U5A.39.13.B02.1.454.CMB.2.raw
  modified_base (302)..(302): a, c, t, g, unknown or other
  misc_feature (302)..(302): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaatactatgtctcttgtaccaacatccaccaggacaaacgtccccaaactgatgatttangagtacacgtaaacgcctgtagggtttctaatcgtcttcctctggctaccaagtctggcaacgaccggccctcctagaccatctcgtcgggctccgaggtctggaggacgaggcttctcttattattggacacgtctacatatacaatctattatctacgttggggtcgttcgggcgggacgggccgttacgtacggtaccgttcgtttacggccgtaaccggccctaacggtcccgtccgccccgtcccggttcgtaaccccg

SEQ ID NO: 307471 - DNA, 577 bp, Homo sapiens
  misc_feature: GZ8MTXP01DLPN9.39.13.B02.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctggggcccaggtctggcccctgactcagcctgcctccgtgtctgggtctcctggacagtcgatcacatctcctgcactggaaccngcagtgacgttggtgttatactntgtctntgacantcaccaggcaagtcccaatgatgattangagtcactaaaccgccttgaggtttacatcgcttcntgctcaagtctgcacaccggcctcccngacctatcctcgtgggccttccgaggccttaggacggtacgaggtccttctacttaattagttcgactaacgtcttacctaattaactaaccaagtctaatttacgtcttaacggtttcgggttggttcgggacgggacgggtacccgttaaccgtcgtaaccgttcgtttacgctaacggacccgtaacgcgtcccgttccccgttggttcccttaacccgg

SEQ ID NO: 307472 - DNA, 636 bp, Homo sapiens
  misc_feature: GZ8MTXP01C3T91.39.13.B02.1.454.CMB.2.raw
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggtggggggggtccctgagactctcctgtacagtctctggattcagctttagcacctatgccatgagctgggtccgccaggctccgaggggaaggggctgggagtgggtctcatccattagtggtgccgagtggtaggtaatacatattatgtggactccgtgaagggccgttcaccatctcagacacaattccaaagaacactctagtatctagaccaaatagaacagcctaagacgccgacgaaggaccacggaccctagttactactgtacgacgtaaactccgtacccgtacgttgtacggtttcgaccctaacctaacgtttcgaccgttccggtcggggggaccgtaaccggggtaaccccgtggtacccacccgttcctaccctccgaccgtccctacccacccgaacggcccctacgttccgtccccgttccccgtcggccccacccgttcccttaccgaacgacgccacccgtcggacggggtccaacgccggg

SEQ ID NO: 307473 - DNA, 689 bp, Homo sapiens
  misc_feature: GZ8MTXP01AUUU3.39.13.B02.1.454.CMB.2.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcacatctcctgcactggaaccngctagtgtacgttggtagttaataactntgtctcttacgaccaacactccaacccaggacaaaccgtaccccaaatgattagtatttagtaggagtacctaacgtaaacccggtcctaggttacgggtttactaagtcgtctttcctcgtcggtcctacgaagttcgtacgaacctaaccgacccgggtccctaccctacgaaccctactccgtcgtcgggccttacgagggtctaggggaacggacggtacgtccttacttacgttatttacgttcgacgtacgtaccttataaactaataaccgaattccttaaattccgtaaccgttcgggtttggggttccgggttaacggggcgggttaacggggtacccgttaccgttacgggtacccgtttacggttcggttacccgtaacggccccgtaaggtccctaccgggttcccttcccggttccgttaaccc

SEQ ID NO: 307474 - DNA, 681 bp, Homo sapiens
  misc_feature: GZ8MTXP01DB0GN.39.13.B02.1.454.CMB.2.raw
  modified_base (224)..(224): a, c, t, g, unknown or other
  misc_feature (224)..(224): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccngcagtgtacgttggtagttataactatgtctcttggaccaacatcacccaggacaaacgtccccaaatgatgtatttatgaggtacaactaaccggccctcgtagggtttcctaagtcgtcttcctcgtgctccaagtctgcaacnccggtccctccncgacactcctcgtcggtcctcgaggctaggacggtacgaggtccttacgtacttaatttagttcggactacggtcctactaacttaactaaaccgtaagtacttaaactttaacgtccgttaacgggtttcgggggtttcggttccgggggaaccggggttaaccggggtaaccccggttacccgttaaccgggttaccccggtttaacggtttacggggttacccgtaacccggtaaccccggtaacggtcccggtccccgttaccccccggttccggttaaccccgtttaacccccg

SEQ ID NO: 307475 - DNA, 580 bp, Homo sapiens
  misc_feature: GZ8MTXP01BYHQY.39.13.B02.1.454.CMB.2.raw
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (499)..(499): a, c, t, g, unknown or other
  misc_feature (499)..(499): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtagttatactatgtctctggtacaacatcaccaggacaaacgtccccaaactgatgatttangagtcaacgtaaacggcctgtaggggtttctaatcgctttccgtctaggctaccaagttaactacgcaaaccgccggtacctcccctgaccctagtccctcgtcgggcctaccgaggtcctggacggacgacggtctctcttattatgcctagcttcaattanaaccgaanctattagtcctaagttcgggtgttcgggngggaccgggtccgacgtcgtaaccggttcgttacggccaacgtcccgaaggtccgtcgttcccccgtcggttaaccctccg

SEQ ID NO: 307476 - DNA, 602 bp, Homo sapiens
  misc_feature: GZ8MTXP01AWC4B.39.13.B02.1.454.CMB.2.raw
  modified_base (227)..(227): a, c, t, g, unknown or other
  misc_feature (227)..(227): n is a, c, g, or t
  modified_base (477)..(477): a, c, t, g, unknown or other
  misc_feature (477)..(477): n is a, c, g, or t
tcagtcgcactagtcacgaccggtgctcgatttagtctagcgacttccgcggggggggtctcaggaggcagcgctctcaggacatctccaccatggcctgggctctgctgcctccccaccctcctcactcagggcacagggtcctgggcccagtctgccctgactcagcctgcctccgtgtctgggtctcctggacagtcgatcaccatcctcctgcactggaaccngcagtgacgttggtagttataactatgtctctgtaccaacatcaccgagacaaacgtcccaaatgatatatttatgagtacaactaaccggccctacgtagggtttactaagtcgtcttctctggtcactagtctagacaacgacggcctccctcgacctactcgtactcgggtctccgaggtcctaggacggaccggacggtctacttacttacgttaattgacctagggacttactaataccttaaanaacgtacttaattactcgttaggttgggttacgggtcgggaacggaccggttaccgtaccgttcgtaccgttacgttacggccgacgcccgtacgtccgtcccgtcccgttcgtccgttccgtcc

SEQ ID NO: 307477 - DNA, 552 bp, Homo sapiens
  misc_feature: GZ8MTXP01ECEQT.39.13.B02.1.454.CMB.2.raw
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (384)..(385): a, c, t, g, unknown or other
  misc_feature (384)..(385): n is a, c, g, or t
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcttgacaacatcaccagacaaacgtccccaatgatgtatttagtgagtacaactaaccggtccctacgtagggttttcaatcgtcttcctctgctcagtctgcacncgccctcagacntctcgngctcagnngacgngagctctctattatgcgagtctactaatactaacagtactaacgttntcgtacgttgggttcggttcggcgggacggggacccgttacgtcggtaacccgttcgttacggttcaaccggccgtaacggccgtcccgttcccccgttcgggttcctaaccccg

SEQ ID NO: 307478 - DNA, 723 bp, Homo sapiens
  misc_feature: GZ8MTXP01BVKXW.39.13.B02.1.454.CMB.2.raw
  modified_base (222)..(222): a, c, t, g, unknown or other
  misc_feature (222)..(222): n is a, c, g, or t
  modified_base (263)..(263): a, c, t, g, unknown or other
  misc_feature (263)..(263): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctggtctccgtggacagtcatcacatctctgcactaggaaccngcagtgtacgttggtagttatactatgtctcgtagaccaanactccaaccgaggaccaaaccgtacccccaaatcgattagtaatttagtaggtaacggtacaaaccgtaaacccggtcccttacggttaacgggggttttacctaaacgttccggtcctttacccgtaccgttcgggtacccttacccgtaaaggttcccgttaacgggaacctaaacccgtaccccgggtccccttacccccgtacggtaaccctacttcccgtcggtcggggacccttccggaacgggtctaggggaacggacggacggtccttacttacttagtttatcgactacgtcttacaattaactaacgaatctaattacgtacgttaccggttggggttcggtccggggacgggaccgggtacccgttccgtacggtacccggttcgttaacgggccaaccggacccgtaacggtccgtccccgttacccccgttcggttaaccttccccg

SEQ ID NO: 307479 - DNA, 749 bp, Homo sapiens
  misc_feature: GZ8MTXP01EW8PF.39.13.B02.1.454.CMB.2.raw
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
  modified_base (391)..(391): a, c, t, g, unknown or other
  misc_feature (391)..(391): n is a, c, g, or t
tcagtcgcactagtcacgaccggtgctcgatttagtctagcgactttgggctgagctgcctttttcttgtggctatgttaaaaaggtgtccagtgtgaggtgcagctgttggagtctgggggaggcttggtacaggcgggggggtccctgagactctcctgtacagtctctggattcagctttagcacctatgccatgagctggtccncaggctcgagggaagggctggagtgggtctcatccattagnggtgccaggtggtaggtaatacatagttatggttggacttccggtaggaaacggggtcccggtttacaacccgtatcctaccgaaggacgaactaaattcccgaaagaacctactctgtaactctagacccaaatcgaaacngccctagacgccggaccgaagggacccacgggtccccttaagtatttaccgtgtacgacgtaaactcctacccgtactttacggtacggttttacgacccctaaaccttaacgttttcgaaccttcccgggttcggggggaccctaacgggggtaaaccccttgggtaccccaccgttcccgtaccctaccgtccgtaccccgttaccccgaaacccgtaaaccgggggccccttaaccggtttcccgggttacccctttccccccgtcgggtaccccttacccccgttcccttacccgaaacgtccggtaacccgttacccgtccggggttaccgggggtaaccaaccggccccggg

SEQ ID NO: 307480 - DNA, 633 bp, Homo sapiens
  misc_feature: GZ8MTXP01CAX2K.39.13.B02.1.454.CMB.2.raw
  modified_base (223)..(223): a, c, t, g, unknown or other
  misc_feature (223)..(223): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctctgcactggaaccngcagtgacgttggtgttaataactatgtctctggaccaacatcacccaggacaaacgtccccaaatgatgatttatgagtacacgtaaacggccctacgtagggtttctaatcgtcttcctctggtcctccaagtcctgggcaaccgaccgggccctcctcgacctatcctcgtggcctcgaggctaggacgggacgaggtcctcttcttaattagttcgactacgtcttacaattaacaaccgtaaagctaaagtttactacgttacggttttcggggtcgggtttccggggacggggttaaccggggtacccgttaccgtacgggtacccgtttacggtttacggttacccgaaccggtaccccgaacgggccctccggccccccgttaaccgggttccttaaccccg

SEQ ID NO: 307481 - DNA, 596 bp, Homo sapiens
  misc_feature: GZ8MTXP01EIPVB.39.13.B02.1.454.CMB.2.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctctcactcagggcacagggtcctgggcccagtctgccctgactcagcctgcctcgtgtctggtctcctggacagtcgatcaccatctctgcactggaaccngcagtgacgttggtagttatactatgtctcttgacaantcacccaggacaaacgtccccaaatgatgtattatgagtacactaaaccgcctacgtagggtttactaatcgcttcctcgtgtactcaagtccgtaggccaacgacggtccctaccctcgtaccatctccgtgggacctccgaggccttggaggacgacggtctacttacttattagttcgactacgtacttaccaaatttacaaacgaacgtactaaactttatacgttaaccggtttgggtgggttcggggacggttacggggacccgttcgtacggtaccgttacgtttagccaacggcccgaagtcctccggccccgttcgttaaccgtcccg

SEQ ID NO: 307482 - DNA, 562 bp, Homo sapiens
  misc_feature: GZ8MTXP01B54FW.39.13.B02.1.454.CMB.2.raw
  modified_base (262)..(262): a, c, t, g, unknown or other
  misc_feature (262)..(262): n is a, c, g, or t
  modified_base (383)..(383): a, c, t, g, unknown or other
  misc_feature (383)..(383): n is a, c, g, or t
  modified_base (502)..(502): a, c, t, g, unknown or other
  misc_feature (502)..(502): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctctgcactggaaccagcagtgtacgttggtagttatactatgtctcttgaccaanatcaccaggacaaacgtccccaaatgatgtatttagtgagtacaactaaaccggccctacgtagggtttactaatcgtacttcctcgtggctaccaagtcacgtcaacgtacggccctccncgacctatcctcgtgggacctccgagtcgtgaacggacgagtctcttacgtattagtcgtcggatctacatactaacaagtactattatcgtagttgggtgtcgggcggttacgggacncgtacgtcgttcgttcgttacaacgtccaacggcctaccgccccgtcggttcctaacccg

SEQ ID NO: 307483 - DNA, 528 bp, Homo sapiens
  misc_feature: GZ8MTXP01EM00A.39.13.B02.1.454.CMB.2.raw
  modified_base (222)..(222): a, c, t, g, unknown or other
  misc_feature (222)..(222): n is a, c, g, or t
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (470)..(470): a, c, t, g, unknown or other
  misc_feature (470)..(470): n is a, c, g, or t
  modified_base (507)..(507): a, c, t, g, unknown or other
  misc_feature (507)..(507): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcaccatctcctgcactggaaccngcagtgacgttggtagttataactatgtctctgacaacatcacccaggcaaacgtccccaaactgatgatttatgagtcactaaacggccctagagggtttctaatcgtcttcctctgctcagtctgcacacgcctcctgacatctcgtgggcctccgaggcgtaggacggacgaggctctcttattattgcacgtctcaatactacaanctaattactctacgttgggtgtcgggnggacgggaccncgtgtaccgttgttcggttccaagtcccgaacggtcncgccccgtcggttcctaaccg

SEQ ID NO: 307484 - DNA, 765 bp, Homo sapiens
  misc_feature: GZ8MTXP01B9VS8.39.13.B02.1.454.CMB.2.raw
tcagtcgcactagtcacgaccggtgctcgatttagtctagcgactttgggctgagctgcctttttcttgtggctatgttaaaaggtgtccagtgtgaggtgcagctgttggagtcgtgggggaggcttggtacaggcggggggggtccctgagactctcctgtacagtctctggattcagtctttagcacctatgccatgagcgtcggggtccgccaggctaccggaggggaaggggcgtgggaggtgggtctcatcctagttaggtgggtcgccgtaggtggtaggtaaatactatattagtgtcgactccgtaggacggtccgttcaccatcctacagaacgactaagtaccaaagtaacacttactgtactctagaccaaagtagaacgacgcctaaggacgccggccggaaacggacccgaccggtacccttaagttacttccgtagtacgaacgtaaacgtcccgtacccgttacgttacggtacggtttccgaacccgtaccgttaaacgtttcgaaccgttcccggtacggggggacccgtaaccggggtaaccccgtcggttacccgtacccgttcccgtcccgtaccgtaccgtcccccgtacccgtaacccggtaacccgggccccttaaccggttccccggttacccccttcccccgtcccggtccccttaccccccgttaccgaccccgtaaacgaccggtaacccgtaccccgggttccgggttaccggggaacccgccgtaaccccggggg

SEQ ID NO: 307485 - DNA, 606 bp, Homo sapiens
  misc_feature: GZ8MTXP01C6X3O.39.13.B02.1.454.CMB.2.raw
  modified_base (225)..(225): a, c, t, g, unknown or other
  misc_feature (225)..(225): n is a, c, g, or t
  modified_base (462)..(462): a, c, t, g, unknown or other
  misc_feature (462)..(462): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggaccaacatcacccaggcaaagtccccaaactgatgatttatgagtcaactaaacggcctcgagggtttcaatcgtactttcctcgtggctaccaagtcttggaacctaaacgcggtccctccctagacctatctcgtggcctccgaggcctaggacggacgaggtcctctactattacttgacagtctacataactaagaacntaacttaactccgtaagtttcggggtggttaacgggacgggttacggggtacccgttacgtacggtaaccgttcggttacggttaccgaacggtaccccgtaacggtcccgtcccggttcccccgtaacggttcccttaacccg

SEQ ID NO: 307486 - DNA, 588 bp, Homo sapiens
  misc_feature: GZ8MTXP01AB9Q9.39.13.B02.1.454.CMB.2.raw
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctactgcactggaaccngcagtgtacgttggtagttataactatagtctcttggtaccaacntccacctaggacaaacgtccccaaactgactgtactttatgaggtacactaaacggccctacgtagggtttctaatcgtcttcctctggctacccagtctggcaaacggtccctaccctgacctatctactcgggtctccgaggtctggaacggacgaggctctccttattaattgactcggtctacatactaactaaacgctaattacgtcgtaggttcggtcggttcgggaacgggacggttaccgtcgttacggtaccgttcgttacggcacgaacccgtacggtccgtccggtccccgttcgtccgttcgtccg

SEQ ID NO: 307487 - DNA, 662 bp, Homo sapiens
  misc_feature: GZ8MTXP01BEI4T.39.13.B02.1.454.CMB.2.raw
  modified_base (222)..(222): a, c, t, g, unknown or other
  misc_feature (222)..(222): n is a, c, g, or t
  modified_base (626)..(626): a, c, t, g, unknown or other
  misc_feature (626)..(626): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctcctgcactggaaccngcagtgacgttggtgttatactatgtctctgaccaacatccaccaggacaaacgtccccaaatgatgtatttatgaggtcaacgtaaaccggccctagtagggtttactaagtcgtctttccgccggtactcccgaagtccgtacgggacctaaccgcccgggtcccctaccccgttacgaaccctaacttcccttacgtacgtacccttacccgaagggtccgttaggacgggaaccggagggtccttaggtaccttaagtttactggtccaagggtcttaccgaattaacttaaccgttagaaaagttcaaacgtttaggttactacccgacgtcgggtcttacgggttcgggacgggttaacgggaccgtaaggtttccgaacccggttcgtaacgggacnccggtacccgaggccctaacccgcccccgttaacgg

SEQ ID NO: 307488 - DNA, 620 bp, Homo sapiens
  misc_feature: GZ8MTXP01E048W.39.13.B02.1.454.CMB.2.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagtcgcactagtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctctgcactggaaccngcagtgacgttggtagttataactatgtctcttggaccaacatcaccaggacaaacgtccccaaatgatgtatttangagtacactaaccggcctcgtagggtttacaatcgtcttcctctgctactagtctcggcaaccgccgccctccctacgaccatctcgtggctccgaggctggaggacgaggcttactcttaattacgttacgcgtacgtcctactaacttaactaacaagtacctttaaatttaccgttacgttacggtttcgggggttcgggttccggggaaccgggggttaaccgggtacccgttaccggtacgtacccgttacggttacggttacgaaccgtacccgaacggtccgtcccgttccccgtcggttaaccttcccg

SEQ ID NO: 307489 - DNA, 644 bp, Homo sapiens
  misc_feature: GZ8MTXP01DNTZR.39.13.B02.1.454.CMB.2.raw
  modified_base (266)..(266): a, c, t, g, unknown or other
  misc_feature (266)..(266): n is a, c, g, or t
  modified_base (357)..(357): a, c, t, g, unknown or other
  misc_feature (357)..(357): n is a, c, g, or t
tcagtcgcactagtcacgaccggtgctcgatttagtctagcgacttccgcgggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcacatctcctgcactggaaccagcaggtgtacggttggtgttaatatatgtctcttgaccaanactccaccgagacaaacgtaccccaatgatagtatttagagacgtacaacgtaaaccggtccctacgtagggtttcctaatcgtctttccncgtcggctaccgagtccgtgcaacgtaccgtccctaccctgacctatctcgtggcctacgagcgtaggaacgcgtgtctcgttacttaattcgtcgacggtactcttaaccaaattaacctaacgaacgtcttaaacttagttaccgtaagggtttcgggttcggttaacccggggacggggttacgggtaccccgttacgtacgggtcccgttacggttggttacccgaacgtacccgtaacgggtcccctacccgttcccccggttaacggttcccgttaacccg

SEQ ID NO: 307490 - DNA, 563 bp, Homo sapiens
  misc_feature: GZ8MTXP01DQQFA.39.13.B02.1.454.CMB.2.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataactatgtctcttgacaacatcaccaggacaaacgtccccaaatgatgtattangaagtcaacgtaaacggcctgtaggtttctaatcgtcttcnctgctcagtctgcacacgcctccngacntctntggctcgaggntggagacgcgtctctactattatcgactagtctacaatactaacaacgataactttatcgtacgggtttcgggtcggttcgggacgggttacgggtacccgttacgtcggtaccgttacgttcgggttaccaacgggtacccgtaacggtcccgtccgttccccgttcggttaacttccccg

SEQ ID NO: 307491 - DNA, 575 bp, Homo sapiens
  misc_feature: GZ8MTXP01AKGMH.39.13.B02.1.454.CMB.2.raw
  modified_base (225)..(225): a, c, t, g, unknown or other
  misc_feature (225)..(225): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgtatactatgtctctgacaacatcaccaggacaaacgtcccaactgatgattatgagtcacgtaacgccctcgtagggtttctaagtcgcttcctctggctcagtctggccacaccggcctccctgaccatctcgtcggtctccgaggtctggacggacgaggcctcttcgtactttagttcgcgtacgtctacaatactaacgatacttattaactctaacggtttggggtcggttcgggacgggacgggtacccgttaccgtacgggtacccgttacgttcggttccgaaccggcccgaacggtccctccggcccccgttcggttcccttcccg

SEQ ID NO: 307492 - DNA, 707 bp, Homo sapiens
  misc_feature: GZ8MTXP01CM7SH.39.13.B02.1.454.CMB.2.raw
  modified_base (228)..(228): a, c, t, g, unknown or other
  misc_feature (228)..(228): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatccactatcctctgcacgtaggaaccngcagttgtacgtttgggttacggtttaataacgttagtgtcttacttaggaacccaacactccaacccaggaccaaaaccggtaccccaaactgactagtatttagtagtacgtaccaacgtaaacccggtccctacggtagggtttacctaagtcgtctttcctcgtcggtctccaaggttccgtaggccaaccgtaccggtccctacccgtacgacctagtcctcgtggcctcgaggtcctaggacggacgtacggtccttctactttacttaagtcgctaacgtccttaacaattaacaaacgtacgtactaagtttacgtccgttaagggtttcgggtacgggttcgggaccgggttaaccggggtacccgttacggttaccggttaaccggttcggtttacggccggtaaacccgtacccggaaccgttcccggtccccggttccccccgtttaacgggttccctttcccccgg

SEQ ID NO: 307493 - DNA, 778 bp, Homo sapiens
  misc_feature: GZ8MTXP01CO0DV.39.13.B02.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctctgcacgtggaaccagcagtgacgttggtagttataactatgtctcttggaccaacatccaccaggacaaacgtccccaatnatgtatttangagtacacgtaaacggccctacgtacgggttactaatcgtactttcccgtacttcggctacccgtaaagtccgttacgggaaccaaaccgtaacccgggtccccttaccccgtacggaaccccttaaacgtcccgttacccgtcgggggtacccctacccggtaaacggggtcccgttacgggaaaccggggtaaccgggtaacgggtccctttaccggttacctttaagtttaacgttacggacggtaacggtaccttaccgtaaagtaaacttaaaccgtaaacgtacttaaacgttttaaacgtccgttaacggtttacgggggtttcgggttaaccgggggtaccgggttaaaccggggtaccccgttaaccggttaccgggtaacccgtttacggttacggttacccgtaaccggaccccgtaaacgggtcccgttcccgttacccccggttcggttaacccgtttccccgg

SEQ ID NO: 307494 - DNA, 810 bp, Homo sapiens
  misc_feature: GZ8MTXP01C7B2V.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccttcctcactcagggcacgagggtcctgggcccagtctgccctgactcagtctgcctcgtgtctggtctcgtggacagtcgatcacatcctcctgcactaggaaccagcagtgacgttggtagttatactatgtctcttaggtaccaacactacaacccaggaccaaacgtaccccaaactgattacgtatttagtaggtaacggtacctaaaccgtaaaacccggtccccgttacgttaacgggggttttaccttaaacgttcggtaccttttccctccgttcgggtaccttacccgtaaacgtttccgtacgggtaaccgtaaacccgtaaccccggggtccccttacccccgtaccggaacccttacgttcccgttaccggttcggggtaccttacccgggacgggtaccgttacgggaaacggggtaccggtaacgggttcccttacttaccgtttaagtttaacgtttcgaccgtacgtacctactaaactttaacgaaccaaagtcttaaacgtttccttacgttaacgggtttcggggttcgggtttaacccgggggacggggttaaacccggggttaccggttacccgttacgggtacccggtttacgggtttacggaccgttaaccgggaccctaacgggtaccccgtccggttacccccgttcgggttaaccctttccccgg

SEQ ID NO: 307495 - DNA, 597 bp, Homo sapiens
  misc_feature: GZ8MTXP01A1G0P.39.13.B02.1.454.CMB.2.raw
  modified_base (226)..(226): a, c, t, g, unknown or other
  misc_feature (226)..(226): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatccaccatctcctgcactggaaccngcagtgtacgttggtgttaataactatgtctcttggaccaacactcaccaggacaaacgtccccaaatgatgtatttagtggagtacaacgtaaaccggccttacgtagggtttctaatcgtcttcctcgtgcctcaagtctcggcaaacgccgccctccctgacctactcgtcgtgggcctcgaggctaggacggacgacggtcttactacgttattagtcgtacggatcttacaatactaacagtctaatactcgtaggttgggtaggttcgggacgggttacgggacccgttacggtccgtaccggttcgttacgggccaacgggtcccgaacggtcctacccggccccttcggttccgttaaccccg

SEQ ID NO: 307496 - DNA, 687 bp, Homo sapiens
  misc_feature: GZ8MTXP01EQUZ0.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcaccatctcctgcactaggaaccagctagtgtacgttggtagttaataactatgtctcttgtacaacatcaccaggacaaacgtaccccaaatgatgatttatagagtacactaaacgccctagtaggttactaatcgtacttcctcgtggctaccgaagtctagggaaccaaacgacccgggtccctaccccgttacggaccctacgttccttacggtcgggtacctaccggaggtacccgttagggaaacgggacggtaacgggtccttacgttaccttaaaggttttaacttcggacctacggtacccttacgtaaattaacaaaccggtaaagtaccttaaaggtttaacctacggtttaacccggtttgggggttcgggtttccgggacgggttaccggggaaccgttaccgttacggtaccgttacgttacgggttccaacgccgaacggtcctcccgttaccccgtcggttcctaacccg

SEQ ID NO: 307497 - DNA, 665 bp, Homo sapiens
  misc_feature: GZ8MTXP01EI6HV.39.13.B02.1.454.CMB.2.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgtacgttggtggttaataactatgtctcttggtaaccaacatcacccaggacaaacgtccccaaangatgtatttagngagtcaactaaaccggccctacgtagggtttactaagtcgtacttccncgtggacctaccgagtacgtacggtccaaccgacccggtccctacccctacgaccctacgtcctcgtcggtccgtaccgaggtcgtagggaacgggacggtacggtcttacttcttaatttacgttcgacggtacgtccttactaacttaactaacgaacgttactaaatttaactcgttaaccggtttggggttcggttccggggacgggaccggggtccttaaccgtacggtacccgttacgttacggttaccgaaccgtaccggtaacggtccgtcccggttccccgttaaccgggttccttcccg

SEQ ID NO: 307498 - DNA, 723 bp, Homo sapiens
  misc_feature: GZ8MTXP01BXMA0.39.13.B02.1.454.CMB.2.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (399)..(399): a, c, t, g, unknown or other
  misc_feature (399)..(399): n is a, c, g, or t
tcagtcgcactagtcacgaccggtgctcgatttagtctagcgacttccgcgggggggggtctcaggaggcagcgctctcaggacatctccaccatggcctgggctctgctgctcctccaccctcctcactcagggcacgagggtcctgggcccagtctcgccctgactcagcctgcctcgtgtctgggtctcctggacngtcactcaccatcctcctgcactacggaaccngcagtgtacggttggtagttaataactatctcgtcttcggaccaanactccacccgagacaaaccgtaccccaatcgatgtattatgagtacactaaccgtcccgtcgtacggtttctaacgtcgtcttctccgtgctacctagtactcgcacgaccgcctccccgtntaccgtactcgtcgtcgggtcctcgtacggcgtacggacggtacggtacggtacctccttacttaacctttagttccgtacggacggtaccttaactaaacttactaaacccgtaagtactttaacgtttacttaccggtttaaccggtttcggggggtttccggtaaccgggggtaaccggggttacccggggtaaaccccggttaacccggtccggtttaacccgttacccggggtttacggtttaccggaacccggtaccccggtaacggtccccggtttccccggcccccgtttaacccggggttaacctttcccccggg

SEQ ID NO: 307499 - DNA, 527 bp, Homo sapiens
  misc_feature: GZ8MTXP02GMX8P.39.13.B02.1.454.CMB.2.raw
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaaacggccctcgaggggtttctaatcgcttcctctggctccaagtctggcaacacggcctcctgaccatctctgggctccaggctgaggacgaggctctctattattgcagctcatatacaagcattatcacgtttggggtcgttcgggcgggtagggacccgacgtcgacccgttcttagggtcaacggcccaaggcctcgccccctcggtctaccg

SEQ ID NO: 307500 - DNA, 517 bp, Homo sapiens
  misc_feature: GZ8MTXP02HIX68.39.13.B02.1.454.CMB.2.raw
  modified_base (320)..(320): a, c, t, g, unknown or other
  misc_feature (320)..(320): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaatgatgatttatgaggtcactaaaacggccctnaggggtttctaatcgcttcctctgctccaagtctggcaacacggcctccctgaccatctctgagctccgaggctgaggacgaggctctctattacttgctagctcaatataacagacatatctactggtgttcggtcggacggacgacgtcgccgtacgttacgtcgacgaccgacgacgtcgccccgtccgtcccg

SEQ ID NO: 307501 - DNA, 529 bp, Homo sapiens
  misc_feature: GZ8MTXP02GQWL3.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgattatgaggtcactaaacggcctcgagggtttctaatcgtcttcctctgctcagtctgcacacgcctcctgaccatctctggctcaggctgaggacgaggctctctattattgacagtctactatatacaagctattactctacgtttgggtgttacgggcggtaggggaccgtaacgtcgtaccgttcttacggtcgaacgtaccccgaaggcctcgcccccgtcggtcctaccg

SEQ ID NO: 307502 - DNA, 537 bp, Homo sapiens
  misc_feature: GZ8MTXP02H5QKU.39.13.B02.1.454.CMB.2.raw
  modified_base (223)..(223): a, c, t, g, unknown or other
  misc_feature (223)..(223): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacggttggggttatgactatgtctctggtaccaacatcacccaggcaaacgtccccaaatgatgattatgaggtcaactaaacggccctagagggtttctaatcgtcttcctctggtctccaagtctggcaacacggccctcctgaccatctcgtggctccgagctgaggacgaggctactctattattgcagctcatataacagctatatctagttgggtgttcgggacgggacggtacccgacgtacgtaccgtcgttacggtccaacgacccgaacggccgtccgcccccgttcggtacctcccg

SEQ ID NO: 307503 - DNA, 526 bp, Homo sapiens
  misc_feature: GZ8MTXP02IKH5H.39.13.B02.1.454.CMB.2.raw
  modified_base (448)..(448): a, c, t, g, unknown or other
  misc_feature (448)..(448): n is a, c, g, or t
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtcccccaaactgatgatttatgaggtcactaaaacggccctcaggggtttctaatcgcttcctctgctccaagtctggcacacggcctccctgaccatctctggctccaggctgaggcgaggctcgtctattattgcagctcatatacaagcattatctacttggggtntttcgggcggtagggaccgaccgtgacccgttcgttaggtcaagtccccaaaggcctcgcccccttcggtacctaccg

SEQ ID NO: 307504 - DNA, 557 bp, Homo sapiens
  misc_feature: GZ8MTXP02H08VU.39.13.B02.1.454.CMB.2.raw
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgccctcgtgtctgggtctctggacagtcgatcacatcctctgcactggaaccagcagtgacgttggtgtataattatgtctctgtcangcatcngcagccgaccccgaaattcttaattatgacggtttctttccggtcgtcccttggtagggtttctaggtcgtctttcccgtcccggtcctacctaagtcgtcggaccacgtaccggtcccttcccgtacgaccctatcctctacgacctccgagctaggagacgaggctagaacttattattgactacgtctactatatacgtagaagtctaaagtgtaactccgagtgtacgtggttcggacggaaggacctagtcgtaccgtacgtaaggtcacgccgagcctccgcccgtcg

SEQ ID NO: 307505 - DNA, 525 bp, Homo sapiens
  misc_feature: GZ8MTXP02IFSG1.39.13.B02.1.454.CMB.2.raw
  modified_base (221)..(221): a, c, t, g, unknown or other
  misc_feature (221)..(221): n is a, c, g, or t
  modified_base (434)..(434): a, c, t, g, unknown or other
  misc_feature (434)..(434): n is a, c, g, or t
tcagtcgcactagtcacgaccggtgctcgatttagtctagcgacttccgcggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcttggtaccaacatcaccaggcaaagtccccaaatgatgattatgaggtcactaaaacggccctcaggggtttctaatcgcttcctctggctccaagtctggcaacacgcctccctgaccatctctggctccagctgaggacgaggctctctattattgcagtctcatatacaaagcattaancacgttgggtgttcggcggacggggaccaaccgtgacccgttcttaaggtccgaagtcccaaacggcctacgtccccctcggttctacccg

SEQ ID NO: 307506 - DNA, 534 bp, Homo sapiens
  misc_feature: GZ8MTXP02JLRUY.39.13.B02.1.454.CMB.2.raw
  modified_base (430)..(430): a, c, t, g, unknown or other
  misc_feature (430)..(430): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatgatgatttatgaggtcactaaacgccctgagggtttcaatcgcttctctgctcagtctggcaacacggcctccctgacctatctcgtgggcctccgaggcctgacggtacgaggtctctactattagttgcagtctacatanaacagctattatctacgttggtcgttcggcggacgggaccgtacgtcgaccgttacgttacggacaacgacccgtaacggcctcgtcccccgtcggtcctaccg

SEQ ID NO: 307507 - DNA, 528 bp, Homo sapiens
  misc_feature: GZ8MTXP02I3CUF.39.13.B02.1.454.CMB.2.raw
  modified_base (267)..(267): a, c, t, g, unknown or other
  misc_feature (267)..(267): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagtcgcactagtcacgaccggtgctcgatttagtctagcgacttccggcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaanatcacccaggcaaagtccccaaatgatgatttatgaggtcactaaacgcctctagggttctaatcgcttctctggctccaagtctggcacacggcctccctgaccatctctgggctcaggctgaggacgaggctcgtntattattgcagtctcatatacaagcattacntagttgggtgttcggcggtacgggaccgtaccgtagtaccgttcttagggttcaaggcccgaaaggcctacggcccccgtaggtcctacccg

SEQ ID NO: 307508 - DNA, 535 bp, Homo sapiens
  misc_feature: GZ8MTXP02JDFGV.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacatcacccaggcaaagtccccaaatgatgatttatgaggtcactaaaacggccctctaggggtttctaatcgcttcctctgctcaagtctggcaacacggcctccctgaccatctctgggctcaggctgagacgaggctcgtctattattgcagctcatatacaagctaattatctacgttgggtgtttcgggcgggaagggtacccgacgtcggacccgttacgttacggtcgaacgcccgaacggcctccgcccccgttcggtactacccg

SEQ ID NO: 307509 - DNA, 509 bp, Homo sapiens
  misc_feature: GZ8MTXP02F7BOZ.39.13.B02.1.454.CMB.2.raw
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaaacggccctcaggggtttctaatcgcttctctggctccaagtctggcaacacggcctccctgaccatctctggctccaggctgaggacaggctctctattattgcagctcatatacaagcattancacttgggtnttcggcggtaggaccgacgtcgaccgtcttaggtcaagcccaaggctcgcccctcggtctaccg

SEQ ID NO: 307510 - DNA, 525 bp, Homo sapiens
  misc_feature: GZ8MTXP02FSKCZ.39.13.B02.1.454.CMB.2.raw
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaatgatgattatgagtcactaaacgcctgagggtttcaatcgcttcctctgctcaagtctggcaacacggcctccctgaccatctctgggctccaggctgaggacgaggctcnctattattgcagctcatatacaagcatttanctacgttgggtgttacggcgggagggaccgaccgttcggaacccgttcgttacggtccaagcccccaagggcctaccgccccctcggtcctaccg

SEQ ID NO: 307511 - DNA, 547 bp, Homo sapiens
  misc_feature: GZ8MTXP02II78E.39.13.B02.1.454.CMB.2.raw
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggngttataactatgtctcttggtaccaacatcaacccaggacaaagtccccaaatgatgattangagtcactaaacgcctgagggttcaatcgcttcctctagctcgaagtctggcaacgacgccctccctcgacatctctggctcgagctgaggacgaggctctactattacttgctagtctctatactacaagactattactactacgtttggggtcgtttcgggacggtacgggacctaccgtacggtacccgttacgtttacggccaacgccgtaaacgtcctacgcccccgttacggtacctacccg

SEQ ID NO: 307512 - DNA, 526 bp, Homo sapiens
  misc_feature: GZ8MTXP02I1U1F.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaacgccctcaggggtttctaatcgcttcctctgctcaagtctggcaacacggcctccctgaccatctctggctcgaggctgagcgagctctctattatgcagctcatatacagtcattatctattgggtgttcggcgggtaagggacccgtaccgtggacccgttcgttaagggtccaagccccgaaggccctcgtcccccgtcggtactacccg

SEQ ID NO: 307513 - DNA, 550 bp, Homo sapiens
  misc_feature: GZ8MTXP02GJC1O.39.13.B02.1.454.CMB.2.raw
  modified_base (239)..(239): a, c, t, g, unknown or other
  misc_feature (239)..(239): n is a, c, g, or t
  modified_base (432)..(432): a, c, t, g, unknown or other
  misc_feature (432)..(432): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtttggnggttataactatgtctcttggtaccaacatcacccaggcaaagtccccaaactgatgattatgaggtcactaaacggcctcaggggtttctaatcgtcttcctctgctcaagtctggcaacacggcctccctgaccatctctgggctccaggctgaggacgaggctctctattattgctagctcatatacaancaattatctacgttggggtcgtttcgggcgggacggggacccgaccgtcggtaacccgtcgttacggttacgaacggccccaagggtcctccggtccccccgttcgggtcctaacccg

SEQ ID NO: 307514 - DNA, 524 bp, Homo sapiens
  misc_feature: GZ8MTXP02IJEPY.39.13.B02.1.454.CMB.2.raw
  modified_base (409)..(409): a, c, t, g, unknown or other
  misc_feature (409)..(409): n is a, c, g, or t
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtacaacatcaccaggcaaagtccccaaatgatgattatgaggtcactaaaacggcctcaggggtttctaatcgcttctctgctccaagtctgcaacacggcctccctgaccatctctggctcaggctgagacgaggctcgtactattattganagtctcatatacaagctattatctaacttgggtgtttcggcgggtacgggaccgaaccgtcgtaccgtacttaggtccaaggcccaaaggtcctacgccccctcggtactacccg

SEQ ID NO: 307515 - DNA, 528 bp, Homo sapiens
  misc_feature: GZ8MTXP02IZDO9.39.13.B02.1.454.CMB.2.raw
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttataactatgtctntgtaccaantcacccaggcaaacgtccccaaatgatgattangagtcaactaaacggccctagtagggtttctaatcgtcttcctctgctaccaagtctggcaacacggcctaccctgaaacntctcgtgggcctaccgngcagacgacgagtctactatattatntcactctactatatananatatatatagtgtggtacggacggacggaccgacgtacgtacgtacgtacgtacgaacgaccgacgacgtccgtcccgtccgtacgtcg

SEQ ID NO: 307516 - DNA, 592 bp, Homo sapiens
  misc_feature: GZ8MTXP02JYO91.39.13.B02.1.454.CMB.2.raw
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
tcagtcgcactagtcacgaccggtgctcgatttagtctagcgacttccgcgggggggtctcaggaggcagcgctctcaggacatctccaccatggcctgggctttgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctgtcaacagcatcaggcagcgccccgaaatcttaatttatgaggtctttcgcggccctnagggtttctagtcgcttctccccggctccaagtctggccaacncggcctccctgaccatctctagactcaggctgagacgagctgactattattgcagctcatatactagaagtacaagttggtactccctactggtcgttacggtttcgggacgggacggggaaaccctaaaggtttaccgaaacccggttccccgtttaacgggggtaaccctaacggggtacccccgtaaaacggggcccgtaccgggtaccccccccgttacggggtttacccccg

SEQ ID NO: 307517 - DNA, 553 bp, Homo sapiens
  misc_feature: GZ8MTXP02JHV7S.39.13.B02.1.454.CMB.2.raw
  modified_base (471)..(471): a, c, t, g, unknown or other
  misc_feature (471)..(471): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcttggtaccaacatccacccaggaccaaagtacccccaaactgatgatttatgaggtcactaaacggccctgtagggtttctaatcgtcttcctctgtctcaagtctggccaacacggcctccctgaccatcctcgtgggcctcgaggctgacggacgaggctcgtctattatgcagtctacatatacaagctattatactacgttgggtcgttacgggngggacgggtacccgacgtacggtacccgttcgttacggtaccaacgacccgaacggtcctccgtaccccctcggtcctaccg

SEQ ID NO: 307518 - DNA, 617 bp, Homo sapiens
  misc_feature: GZ8MTXP02GLYKB.39.13.B02.1.454.CMB.2.raw
  modified_base (302)..(302): a, c, t, g, unknown or other
  misc_feature (302)..(302): n is a, c, g, or t
tcagtcgcactagtcacgaccggtgctcgatttagtctagcgacttccggcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggacaaacgtccccaaatgatgatttangagtcaactaaacggccctgtagggtttctaagtcgtacttcctcgtcgctaccaagtcctggccaaacgaccggtccctaccctgaaccctattcctacgtcggggtcctccgaggctaggaacggaccggaaggccttacgtaccttaagtttaattcgactagtcctactattaacaacaagctaattactctacgtttggggtcgttcgggacggggtaacgggtacccgaaccgttcggaacccgtttcgttaacgggtccaacgggcccctaaaggcccgtacccggtcccccgttcgggtacctcccg

SEQ ID NO: 307519 - DNA, 564 bp, Homo sapiens
  misc_feature: GZ8MTXP02J1KXF.39.13.B02.1.454.CMB.2.raw
  modified_base (301)..(301): a, c, t, g, unknown or other
  misc_feature (301)..(301): n is a, c, g, or t
  modified_base (429)..(429): a, c, t, g, unknown or other
  misc_feature (429)..(429): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcttggtaccaacatcacccaggcaaagtccccaaactgatgatttangaggtcactaaacggccctcaggggtttctaatcgcttcctctgctcaagtctggcaacgacggcctcctcgaccatcctcgtcgggctccgaggctgaggacgaggctctactattattgcagctanactatacaagctattatctacgttggggtcgttcgggacgggtacgggacccgtaaccgtcggtaacccgttcgttaacggttccgaacggtaccccgaaggtccctccggcccccttcgggtccttaaccccgg

SEQ ID NO: 307520 - DNA, 539 bp, Homo sapiens
  misc_feature: GZ8MTXP02JSYF1.39.13.B02.1.454.CMB.2.raw
  modified_base (299)..(299): a, c, t, g, unknown or other
  misc_feature (299)..(299): n is a, c, g, or t
  modified_base (435)..(435): a, c, t, g, unknown or other
  misc_feature (435)..(435): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatgatgatttangaggtcactaaacggcctcgagggtttctaatcgcttcctctggctccaagtctggcaacacggcctcctgaccatctcgtggctccaggctgaggacgagctctctattatgcagctacatatacaagcattacncacgttgggtgttacgggcggacgggaccgacttacggacccgttcgttaacggtcaacggccccgaaaggtcccttaccgccccccttacgggtccttacccg

SEQ ID NO: 307521 - DNA, 531 bp, Homo sapiens
  misc_feature: GZ8MTXP02HOGO0.39.13.B02.1.454.CMB.2.raw
  modified_base (378)..(378): a, c, t, g, unknown or other
  misc_feature (378)..(378): n is a, c, g, or t
  modified_base (426)..(426): a, c, t, g, unknown or other
  misc_feature (426)..(426): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaatgatgatttatgaggtcactaaacggccctacaggggtttcaatcgcttcctctggctccaagtctggcaacgacgcctcctgaccatcnctggctcaggctgaggacgagctctctattattgcagctcatatacancattactcacgttgggtcgttacggcggacgggaccgacgtcgaccgtcgttaacggtccgaagccccgaaaggtcctaccggcccccgttcgggtccctacccg

SEQ ID NO: 307522 - DNA, 532 bp, Homo sapiens
  misc_feature: GZ8MTXP02H1TKN.39.13.B02.1.454.CMB.2.raw
  modified_base (433)..(433): a, c, t, g, unknown or other
  misc_feature (433)..(433): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacatcacccaggcaaagtccccaaatgatgattatgaggtcactaaacggccctgagggtttctaatcgcttcctctgctccaagtctggcaaacactcgcctccctgacctatcctcgtggctccgaggctggaggacgagctctactattatgctagctcatataacanactattatactacgttgggtcgttcgggcgggacgggtacccgacgtcgaccgttgtacggtcgacgacccgacgggtcctccgtcccccgtcggtccc

SEQ ID NO: 307523 - DNA, 523 bp, Homo sapiens
  misc_feature: GZ8MTXP02IMPV0.39.13.B02.1.454.CMB.2.raw
  modified_base (317)..(317): a, c, t, g, unknown or other
  misc_feature (317)..(317): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaatgatgatttatgagtcactaaaacgcctnagggttctaatcgcttcctctgctcaagtctgcaacacgcctccctgaccatctctcggctccagctgaggacgaggctctctattacttgcagtctacatataacaagacatatatactggtggttcggtcggagggaccgaccgtacgtaccgtcgttacgttacgaacgaccgaacgacgtccgtccccgtccgtccgtaccg

SEQ ID NO: 307524 - DNA, 684 bp, Homo sapiens
  misc_feature: GZ8MTXP02JGASL.39.13.B02.1.454.CMB.2.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgagactcctggacagtcgatcacatctcctgcactggaaccngctaggtgtacgttggtntattataattntcgtctcgtgtacaacngctatcgagcacgccgaccctaattacttaattagtgtacgtttcgtttccggtccggtcccgtacggttacgggtttctacgttcccgtccttccgtccgtctacgtaacgttcgtcggacctaaaccgaccgtaccctccctacgtacctactacctactacgtacctaccgacggtcgtaggacggacgacggtctagtaacttagttacgtacgacgtacgtacctactaacttaacgtaacgtaacgtaaacgttacgtaaacgttacggtaacctaccgtacggttcggtaccggttacggggttaccgggggaacggggtaacgggtaaccgttaacgggtttaccggtaacccggttaccggtacgggtacccgaccggtaaccccggtaaccgggtcccgtaccccgg

SEQ ID NO: 307525 - DNA, 541 bp, Homo sapiens
  misc_feature: GZ8MTXP02J1FDQ.39.13.B02.1.454.CMB.2.raw
  modified_base (298)..(298): a, c, t, g, unknown or other
  misc_feature (298)..(298): n is a, c, g, or t
  modified_base (417)..(417): a, c, t, g, unknown or other
  misc_feature (417)..(417): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacatcacccaggcaaagtccccaaatgatgatttangaggtcactaaacggcctgagggtttctaatcgcttcctctggctcaagtctggcaacaccggcctcctgaccatctctggctccaggctgaggacgaggctctctattattgcagctnatatacaagtcatttactactacgttgggtgttcggggcgggtacgggacccggaccgtcggtacccgttcgttaacggtcaaccgcccgaaacggtccgtccgcccccttgggtccctacccg

SEQ ID NO: 307526 - DNA, 530 bp, Homo sapiens
  misc_feature: GZ8MTXP02I2T5N.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaacgtcccccaaactgatgatttatgaggtcactaaacggccctcgaggggtttctaatcgtcttcctctgctccaagtctgcaacacggcctccctgaccatctctagactcaggctgagacgagctgactattattgcagctactatatactagtaatcaaagtgtatacctactggcgttggttcgggacgggacgggaacctaagttcgaccgttcgtacggtcacgacccaaggcctacgtcccccg

SEQ ID NO: 307527 - DNA, 561 bp, Homo sapiens
  misc_feature: GZ8MTXP02HP951.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaaacggccctcgtaggggtttctaatcgcttcctctgctccaagtctggcaacacggcctccctgaccatcctctcgggcctccgaggctgaggacgaggctcgtctattattgcagctcatatacaagcattatctacgttgggtgttcggcgggacggggacccgaaccgttcggacccgttcgtttacgggtccgtaacggaccccgaaacgggtccctaccgccccccgtcgggttacctaccccg

SEQ ID NO: 307528 - DNA, 551 bp, Homo sapiens
  misc_feature: GZ8MTXP02GVXS3.39.13.B02.1.454.CMB.2.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcttggtaaccaanatccaccaggacaaacgtccccaaatgatgtattanagagtcaacgtaaacgcctagtagggtttcaatcgtcttcctctggctaccgaagttcnggcaacacggcctaccctgaccatctcgtcgggacctcccgaggctaggaggacgagcttctacttattatgactagtctacaatanaaacagtactattacactacgttgggtcgtcggacggacggaccgtacgtacgaccgtacgttaacgcaacggaccaacggctcccgcccgtcgtacctccg

SEQ ID NO: 307529 - DNA, 529 bp, Homo sapiens
  misc_feature: GZ8MTXP02HX7QS.39.13.B02.1.454.CMB.2.raw
  modified_base (294)..(294): a, c, t, g, unknown or other
  misc_feature (294)..(294): n is a, c, g, or t
  modified_base (429)..(429): a, c, t, g, unknown or other
  misc_feature (429)..(429): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctctggtacaacatcaccaggcaaagtccccaaatgatgatttangaggtcactaaacgcctcgagggtttctaatcgcttcctctgctccaagtctggcaacgacggccctccctgacccatcctctcgggctccaggctgaggacgaggctctctattattgcagtctcatatacaancattatctacgttgggtgttcgggcggacggaccgtaccgtacgaccgttacgttaggtccaacgcccaaacggtcctccgcccccgttggtcctacccg

SEQ ID NO: 307530 - DNA, 539 bp, Homo sapiens
  misc_feature: GZ8MTXP02JQ68V.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttatgagtcactaaacggcctcgaggggtttctaatcgtcttcctctggctccaagtctggcaacacgcctcctgaccatctctggcctcgagctgagacgaggctctctattattgcagctcatatacaagctattatctacgttgggtcgtttcggcgggtacgggaccgtaccgtacgtaccgtacgttacggtccaacggtcccgaaacggtcctccggcccccgttcggtcctacccg

SEQ ID NO: 307531 - DNA, 522 bp, Homo sapiens
  misc_feature: GZ8MTXP02JFPIL.39.13.B02.1.454.CMB.2.raw
  modified_base (301)..(301): a, c, t, g, unknown or other
  misc_feature (301)..(301): n is a, c, g, or t
  modified_base (441)..(441): a, c, t, g, unknown or other
  misc_feature (441)..(441): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaacgtccccaaactgatgatttangaggtcactaaaacggccctacagggtttctaatcgcttcctctgctcaagtctggctaacacggcctccctgaccatctctgggctccgaggtctgagacgaggctctctattatgcagctcatataacaagctattanctacgttgggtcgttcggcggtaggaccgactcggaccgtacttaggtcaacggcccaaggcctacgccccttcggactcc

SEQ ID NO: 307532 - DNA, 587 bp, Homo sapiens
  misc_feature: GZ8MTXP02H2JUZ.39.13.B02.1.454.CMB.2.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (291)..(291): a, c, t, g, unknown or other
  misc_feature (291)..(291): n is a, c, g, or t
  modified_base (444)..(444): a, c, t, g, unknown or other
  misc_feature (444)..(444): n is a, c, g, or t
tcagtcgcactagtcacgaccggtgctcgatttagtctagcgacttccgcgggggggtctcaggaggcagcgctctcaggacatctccaccatggcctgggctctgctgctcctccaccctcctcactcagggcacagggtcctgggcccagtctgccctgactcagcctgcctcgtgtctgggtctctggacngtcatcacatctcctgcactggaaccngcagtgacgttggtgttataatatgtctctgtaccaacatcaccaggcaaagtccccaaatgatgattangagtacacgtaaacgactacgtagggttactaagtcgtcttctcgtgtctcaagtctagcaaccgacgtcccctcctagtaccatctcgtgggacctccgaggctgacggacgaggtctctctatttagtcgctacgtctacataacacaacnctaattactacgtacgttggggttacgttcggggacggggtacggggaacccgtaccggtcggtaacccggttacgtttacgggtaccgtaaccggacccgaaacggggtccctccggtccccccgttcggtacccttcccgg

SEQ ID NO: 307533 - DNA, 534 bp, Homo sapiens
  misc_feature: GZ8MTXP02GJYW2.39.13.B02.1.454.CMB.2.raw
  modified_base (301)..(301): a, c, t, g, unknown or other
  misc_feature (301)..(301): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttangagtcactaaacgcctcgagggtttcaatcgtcttcctctgctcaagtctgcaacacggcctcctgaccatctcgtcggctccgaggctgaggacgaggtctctctattattgctagctcattanacaanctattatctacgttgggtagttcgggcgggacgggaccgtacgtcggtacccgttcgttaggtccaacgcccgaaacggcctccgccccttcggtcctacccg

SEQ ID NO: 307534 - DNA, 539 bp, Homo sapiens
  misc_feature: GZ8MTXP02I8UZV.39.13.B02.1.454.CMB.2.raw
  modified_base (379)..(379): a, c, t, g, unknown or other
  misc_feature (379)..(379): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacatcaccaggcaaagtccccaaactgatgatttatgaggtcaactaaacggccctcgtaggggtttctaatcgcttcctctgctcaagtctgcaacacggcctccctgaccatctntggctcagctgagcgagctctctattattgcagtctcatatacaagacattatatacttaggttggttcggtcggtacgggaccggtaccgtacgtaccgtaccgttacggttacgtaacgacccgaacggaccgtccgccccgtcccggtccgtacccg

SEQ ID NO: 307535 - DNA, 542 bp, Homo sapiens
  misc_feature: GZ8MTXP02GVFM8.39.13.B02.1.454.CMB.2.raw
  modified_base (224)..(224): a, c, t, g, unknown or other
  misc_feature (224)..(224): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggtaccaacatcacccaggcaaacgtaccccaaatgatgatttatgagtcaactaaacggccctacgaggggtttctaatcgtcttcctctgctcaagtctggcaacacggcctccngacntctctagactccaggctgagacgaggctgactattattgcagtctcatatacgtagaagtacaagttggtactcacgtcggtcttggttcgggcggaacgggacctaacggttcgaaccgttccgtaggtaccgacgacccgaaggtcccgtaccgtccccccgg

SEQ ID NO: 307536 - DNA, 547 bp, Homo sapiens
  misc_feature: GZ8MTXP02JRT02.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttatgagtcactaaacggccctgaggggtttctaatcgtcttcctctggctcaagtctggcaacacggccctcctgacccatctctgggcctccgaggctgaggacgaggctctctattatgcagctcatatacaagctattatctacgtttggggtcgtttcgggcgggtacggggacccgtaccgtacggtacccgttcgttaaggtccaacggaccccgaaggccgtccgcccccgtcggtcctacccg

SEQ ID NO: 307537 - DNA, 545 bp, Homo sapiens
  misc_feature: GZ8MTXP02I5DF5.39.13.B02.1.454.CMB.2.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
tcagtcgcactagtcacgaccggtgctcgatttagtctagcgacttccggcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacatcacccaggcaaagtccccaaatgatgatttangaggtcactaaacggcctgagggtttctaatcgtcttcctctggctccaagtctggcaacncggcctccctgaccatctctgggctccaggctgagcgaggctctactattattgcagtctcataatacaagctattanctagttgggtgttcggacgggacgggacccgtacgtacggtacccgttacgttacggacgtaacggacccgtaaaggccctcggtccccctcgggtaccttacccg

SEQ ID NO: 307538 - DNA, 518 bp, Homo sapiens
  misc_feature: GZ8MTXP02IAXHO.39.13.B02.1.454.CMB.2.raw
  modified_base (299)..(299): a, c, t, g, unknown or other
  misc_feature (299)..(299): n is a, c, g, or t
  modified_base (400)..(400): a, c, t, g, unknown or other
  misc_feature (400)..(400): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatgatgatttangaggtcaactaaacggcctgagggtttctaatcgtcttcctctgctcaagtctggcaacacggcctccctgaccatctctggctcgagctgagacgagctntctattattgcagtctacatattacaagtcaagttaactactcgttccttttcggacggtagggaccaagcttacgaccgtcgtagtcaacgcccaagcctcgcccccgtcgtctacc

SEQ ID NO: 307539 - DNA, 549 bp, Homo sapiens
  misc_feature: GZ8MTXP02IVW1K.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtggttataactatgtctcttggtaccaacatcaccaggcaaacgtccccaaactgatgatttatgagtcactaaacggcctctaggggttctaatcgtcttctctggctccaagtctgcaacacggcctccctgaccatctctggctcgagctgaggcgaggctctctattattgacacgtctcatatacaagactattactctacgttgggtcgttcggggacggacgggaccgtaccgtacggtacccgttacgttacggtcgaacgccccgtaaacggccgttaccggcccccgttcggtccttaacccg

SEQ ID NO: 307540 - DNA, 547 bp, Homo sapiens
  misc_feature: GZ8MTXP02GG0DK.39.13.B02.1.454.CMB.2.raw
  modified_base (440)..(440): a, c, t, g, unknown or other
  misc_feature (440)..(440): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttatgaggtcactaaaacggccctacaggggtttcaatcgcttcctctggctccaagtctggcaacacggcctccctgaccatctctgggctccaggctgaggacaggctctctattattgcagcttcatatacaagacattatnacttggtgttcggtcgggacgggaccggaaccgtcgaccgttaccgttacggttacgtaacgacccgaaacggaccgtccgtcccccgtcccgggtccgttaacccg

SEQ ID NO: 307541 - DNA, 519 bp, Homo sapiens
  misc_feature: GZ8MTXP02I9GYQ.39.13.B02.1.454.CMB.2.raw
  modified_base (347)..(347): a, c, t, g, unknown or other
  misc_feature (347)..(347): n is a, c, g, or t
  modified_base (418)..(418): a, c, t, g, unknown or other
  misc_feature (418)..(418): n is a, c, g, or t
  modified_base (497)..(497): a, c, t, g, unknown or other
  misc_feature (497)..(497): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataacatgtctctgtaccaacatcacccaggcaaagtccccaaatgatgatttatgagtcactaaacgcctgagggtttcaatcgcttctctgctcagtctgcacncggcctcctgaccatctcgtggcctcgaggctgaggacgaggctctctattattgcagtctcatataacanctattaatctacgttgggtgttcgggacggacgggacccgacgtcgaccgttcgttaggtacaacgtcccgaacggtcnccgccccgttcggtacctaccg

SEQ ID NO: 307542 - DNA, 583 bp, Homo sapiens
  misc_feature: GZ8MTXP02IANYB.39.13.B02.1.454.CMB.2.raw
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacaggggtcctgggcccagtctgccctgactcagcctgccctcgtgtctgggtctcctggacagtcgatcaccatctcctgcactggaaccngcagtgacgttggtgttataactatgtctcttggtaccaacatcacccaggcaaagtcccccaaatgatgatttatgaggtacaacgtaaaaccggcctcgaggggtttctaatcgctttccnctggctcaagtctggcaacacggcctccctgacatcctctgggcctcgaggctgaggacgaggctctctattatgcagctacataatacaagctattaactcgtaacgtttgggtacggtttcgggcgggaacggggtaccgaaccgtacggtacccgttacgtttaacgggaccgtaaccggaccccgaaacggggtcccttacccggcccccgttacgggttccccttacccg

SEQ ID NO: 307543 - DNA, 509 bp, Homo sapiens
  misc_feature: GZ8MTXP02FE0H4.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccngcagtgacgttggtgttacaactatgtctcctggtaccaacaacaccccggcaaacgcccccgaagtcatgatttatgacgtcactaatcggccctcaggggtgtctaatcgcttcctctggctccaagtctggcaacacggcctccctgaccatctctgggctccaggctgaggacgaggctgattatactgcagctcatattcaagcagtatactgtcctttcggcggtaggaccaagctacgaccgtcagtcaacgcccaaggctcgccccctcggctaccg

SEQ ID NO: 307544 - DNA, 536 bp, Homo sapiens
  misc_feature: GZ8MTXP02HWHDO.39.13.B02.1.454.CMB.2.raw
  modified_base (364)..(364): a, c, t, g, unknown or other
  misc_feature (364)..(364): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctgtaccaacatcaccaggacaaagtccccaaatgatgattatgagtcaactaaacggccctgagggtttactaatcgtcttcctctgctcaagtctgcaacacgcctcccngaccatctctggctcaggctgaggacgaggctctctattattgctagtctactatactacaagactattatctacgttgggtacgttcgggcggacgggacccgtacgtacgtaccgtcgttacggtacaacggtcccgaacggtcctaccgtcccccgtacggtcctaccg

SEQ ID NO: 307545 - DNA, 558 bp, Homo sapiens
  misc_feature: GZ8MTXP02J009B.39.13.B02.1.454.CMB.2.raw
  modified_base (300)..(300): a, c, t, g, unknown or other
  misc_feature (300)..(300): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttangagtcactaaacgcctgagggtttctaatcgcttcctctggctccaagtctggccaacacggcctccngaccatcnctggctccgagctgaggcgaggctctactattattgcagctcatatacaagtacatttacnctacgttggggtcgttcgggacgggacgggacccgtaacgttcggtacccgttacgttacgggttaccaacggtaccccgaaacgggtcccttacccggccccccgtcgggtactaccccg

SEQ ID NO: 307546 - DNA, 600 bp, Homo sapiens
  misc_feature: GZ8MTXP02GQPIO.39.13.B02.1.454.CMB.2.raw
  modified_base (262)..(262): a, c, t, g, unknown or other
  misc_feature (262)..(262): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctgtaccaanatcaccaggacaaacgtccccaaatgatgtatttagtgaggtcaactaaacggccctagtaggggtttactaacgtcgtacttcctcgtggtctaccaagtcctagggccaaacgaccggccctccctacgaccatcctcgtgggtcctccgaggtctggacgacggaggtctagtattatacgtgactagtctactattagactaaatcgaggtgacggtactttagtacgtttacgttacggggtaaggttacggggtaaaccaaggggttaccaacgttccgtaccgtaaggtacaaccggtacccgaaacggtacccccaacccgtacgttccg

SEQ ID NO: 307547 - DNA, 560 bp, Homo sapiens
  misc_feature: GZ8MTXP02JVHTC.39.13.B02.1.454.CMB.2.raw
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggacaaagtccccaaatgatgatttatgaggtcactaaaacggccctacgaggggtttctaatcgtcttccctctgctccaagtctggcaacacggcctcctgaccatcnctggctcagctgagacgaggctntctattatgcngctcatatacagctattactctacgttgggtcgttcgggacgggtaggggtacccgaccgtacggtacccgttcgtttaacgggtacctaacggaccccgaaacggtcccgtcggtacccccccgttcgggtacccttacccg

SEQ ID NO: 307548 - DNA, 555 bp, Homo sapiens
  misc_feature: GZ8MTXP02JF163.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttatgagtcactaaacggccctacgtaggggtttctaatcgtcttcctctgctcagtctggcaacacggcctccctgaccatctctgggcctcccgaggctggagacgaggctcgtctattattgacagctcatatacaagtctattatctacgttggggtacgttcgggacgggacgggtacccgaccgttcggacccgttacgttacggtccaacggtcccaaacgggtccgtccgtcccccgtcggtacctacccg

SEQ ID NO: 307549 - DNA, 516 bp, Homo sapiens
  misc_feature: GZ8MTXP02GZ18S.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaacgtccccaaactgatgatttatgagtcactaaacgccctgagggtttcaatcgcttcctctgctccaagtcttggcaacaccggcctccctgaccatctctgggctccgaggctgaggacgaggctctctattattgcagctcatatacaagcaattatcacgttgggtgttcggcgggaagggccgactcgaaccgttctaggtcaacgcccaaggcctcgcccccgtcgtctacc

SEQ ID NO: 307550 - DNA, 540 bp, Homo sapiens
  misc_feature: GZ8MTXP02JC4KF.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttatgaggtcactaaaacggcctcgaggggtttctaatcgcttcctctgctccaagtctggcaacacggcctacctgaccatctctggctcgagctgagcgagctctctattattgcagctcataatacaagctattatctaacgtttgggtacgtttcgggacgggagggacccgtaccgtcggtaacccgttcgttaacggtccaaggccccgaaaggcctcggcccccgtcggtacctcccg

SEQ ID NO: 307551 - DNA, 553 bp, Homo sapiens
  misc_feature: GZ8MTXP02IJH7Y.39.13.B02.1.454.CMB.2.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctggcctgacacagcctgcctcgtgtctgagactcctggacagtcgatcaccatcctcctgcactggaaccagcagtgacgttgngcttatattatgtctctgtcaangcatcagcagcgacccgaatcttaattangagttctttcgcgcctgtagggtttctagtccgtcttctccggctccaagttctggcaacnccggccctcccngaccatctcaagctccgaggctggacggacgacggctagacttaatttagttcgctaagtcctataatactagtaggaatacgaattggtactccgtacgtggtcctggttacgggacggtacggggtaaaccttaggttacggaacccgttacgtacggtaccaacgtccccgaaagggtcctcccccgg

SEQ ID NO: 307552 - DNA, 544 bp, Homo sapiens
  misc_feature: GZ8MTXP02G444G.39.13.B02.1.454.CMB.2.raw
  modified_base (373)..(373): a, c, t, g, unknown or other
  misc_feature (373)..(373): n is a, c, g, or t
  modified_base (426)..(426): a, c, t, g, unknown or other
  misc_feature (426)..(426): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttatgaggtcactaaacggccctcaggggtttctaatcgtcttcctctggctccaagtctggcaacacggcctcccngaccatctctgggctcaggctgaggcgaggctctctattattgcagctcatanacaagctattatctacgttgggtcgttcggcgggacgggtaccgaccgtcggacccgttcgttacggtaccaacggtacccgaaacggtccgtccgtcccccgtacgggtcctacccg

SEQ ID NO: 307553 - DNA, 536 bp, Homo sapiens
  misc_feature: GZ8MTXP02FU4FN.39.13.B02.1.454.CMB.2.raw
  modified_base (369)..(369): a, c, t, g, unknown or other
  misc_feature (369)..(369): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatgatgatttatgaggtcactaaacggcctcgagggtttctaatcgcttcctctgctccaagtctggcaacacggcctcccngaccatctctgggctcgagctgaggacgaggctgattattactgcagctcatttgcaatcagtgaggtctttagtgtcgttacgggaagttcgggaacctaagggtcctaagtccgtaccgtaagggtccaacggaccccaagggaccccaaaccccgtacttaccg

SEQ ID NO: 307554 - DNA, 518 bp, Homo sapiens
  misc_feature: GZ8MTXP02IP36L.39.13.B02.1.454.CMB.2.raw
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaccatgtctcttggtaccaacatcacccaggcaaagtcccccaaactgatgatttatgaggtcactaaacggccctcagggtttctaatcgcttcctctgctccaagtctggcaacacggcctccctgaccatctcgtggctccaggctgagcaggctcnctattattgcagctcatatacagcattanctacgttgggtgttcgggcggagggaccgacctggaccgttcttaggtcaacgccccgaaggcctcgcccccgttcggtctaccg

SEQ ID NO: 307555 - DNA, 505 bp, Homo sapiens
  misc_feature: GZ8MTXP02HN9Z5.39.13.B02.1.454.CMB.2.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
tcagtcgcactagtcacgaccggtgctcgatttagtctagcgactttccggcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctggcactggaaccngcagtgacgttggngttataactatgtctcttggtacaacatcaccaggcaaagtccccaaatgatgatttangaggtcactaaacggccctanaggggttcaaatcgcttacctctgctccaagtcnggcaaactcgcctcccanacntcncngcncagcngagacgtagctctatattagtcnagntnanatacacatatatatagtgtggtcggcggacggacgacgtacgtacgtacgttacgtacgaacgacgacgacgtcgtccgtccgtctcg

SEQ ID NO: 307556 - DNA, 518 bp, Homo sapiens
  misc_feature: GZ8MTXP02HLBVH.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggttccaacagcattcaggcagcgccccgaaactcttaattatgagtctttcgtcgcctctagggttctagtcgtcttcctccggctcaagtctggcacgacgcctccctgacctatctctagactccagctgagacgaggctgactattattgcagctcatatactagaagtcaaatggtactccatcggacttggttcggcgtaggggacctaaggttcgaccgtcgtaaggtcacgcccaaggcctacgcccccttacgg

SEQ ID NO: 307557 - DNA, 555 bp, Homo sapiens
  misc_feature: GZ8MTXP02G9Y2Y.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggacaaacgtccccaaatgatgatttatgaggtcaactaaaccggccctacgaggggtttactaatcgtcttcctctgctcagtctgcaacacgcctcctgaccatctcgtgggcctccgaggctgacggacgaggctctacttattattgcagtctacattataacaaagtctaattactctacgttgggtcggtttacgggcgggtacgggacccgtacgtcggaccgttcttagggtccaacggacccaacggtcctccgcccccgtcggtcctacccg

SEQ ID NO: 307558 - DNA, 623 bp, Homo sapiens
  misc_feature: GZ8MTXP02JJUGI.39.13.B02.1.454.CMB.2.raw
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (541)..(541): a, c, t, g, unknown or other
  misc_feature (541)..(541): n is a, c, g, or t
  modified_base (604)..(604): a, c, t, g, unknown or other
  misc_feature (604)..(604): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcgggggggtccctgagactctcctgtacagtctctggattcagtctttagcacctatgccatgagcgtggtccgcaggctccgaggggagggctggagtggtctnatccattagtggtgcaggtggtagtaatacatattatggtggactccggtggaacgggtccgttcacctntcctcagacgaactacttaccaaagacncttctagtatctagaccgaaatcgaacacgcctaggacgccggaccggaacggaccgacccggtacccttaagttactttacgtgtacgaacgtaaacttccgtacccgtagtttacgtacggtttcaccctaacctaacgtttcgaccgttccggtacggggacctaccggggtaccttcgggacctaccgtctcctcgacnccctaccgacgacggcctacgtccgtccctcccgtcggccctaccgtcgaccgccgacggacnccaccgtccgacgacaccg

SEQ ID NO: 307559 - DNA, 554 bp, Homo sapiens
  misc_feature: GZ8MTXP02FWFEO.39.13.B02.1.454.CMB.2.raw
  modified_base (282)..(282): a, c, t, g, unknown or other
  misc_feature (282)..(282): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagcggggggggtccctgagactctcctgtacagtctctggattcagctttagcacctatgccatgagctgggtccgccagggctccgaggggaaggggctggagtgggtctcatccattagtggtgccaggtggtggtaatacatattangtggactccgtgaagggccgttcaccatctcagagacaattccaaagacactctgtatctgaccaaaatgaacagcctgagcgcgaggacacgcctatattactgtgcgaaatctcccgacttgagtttcgaccacctaactttcgactccgtggggccacgggaccctgggtccaccgtctcctcacgcctaccaccgacggcccacgtccggtccttccccgtcggccctaccctcctaccaacgacgccaccgtcgcggggccacgcgg

SEQ ID NO: 307560 - DNA, 504 bp, Homo sapiens
  misc_feature: GZ8MTXP02IVLE0.39.13.B02.1.454.CMB.2.raw
  modified_base (296)..(296): a, c, t, g, unknown or other
  misc_feature (296)..(296): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcaccaggcaaagtccccaaatgatgattangagtcactaaacgcctcagggttcaatcgcttcctctgctcaagtctggcaacacggcctaccctgaccatctctggctccaggctgacgacgagctctctattattgcagtctcataanacanatatatatacgtgtgtcggtcggacggacgtacgtacgtacgtacgtacgtacgaacgacgacgtcgtccgcccgtccgtactc

SEQ ID NO: 307561 - DNA, 544 bp, Homo sapiens
  misc_feature: GZ8MTXP02I0YGG.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaatgatgatttatgaggtcactaaaacggccctacacggggtttctaagtcgcttcctctggctccaagtctggcaacacggcctccctgaccatctcgtggctccaggctgaggacgaggctcgtctattattgcagtctacatatacaagctattatctacgttggggttagttcggcggtagggacccgtaccgttcggacccgttcgttaggtccaagacccgtaacggcctccgcccccgtcggtacctaccg

SEQ ID NO: 307562 - DNA, 557 bp, Homo sapiens
  misc_feature: GZ8MTXP02JPF5F.39.13.B02.1.454.CMB.2.raw
  modified_base (300)..(300): a, c, t, g, unknown or other
  misc_feature (300)..(300): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaactgatgatttangagtcactaaacggcctcagggtttctaatcgtcttcctctggctccaagtctggcaaacacggccctccctgacccatcctcgtcgggcctccgaggctgaggacgaggctctctattattgcagcttcatatacaagctaattatctacgttgggtgtttcgggacgggtacggggtacccgaccgttcggacccgttacgttacgggctaacggcccgtaaacggcctaccggccccctcgggtacctaccccg

SEQ ID NO: 307563 - DNA, 646 bp, Homo sapiens
  misc_feature: GZ8MTXP02GCUW9.39.13.B02.1.454.CMB.2.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcttgaccaanatccaccaggacaaacgtaccccaaatgatagtatttagngtaggtacaacgtaaaccggccctagtagggtttactaagtcgtcttccgtctggcctaccgaagttctacggccaaccgacccggtccctcccgtacgaacctacttcctacgtcgggtccctaccgaggtccgtagggacggacggaggtcttagtaattacttacgtgactagtcctacgttagtttacacctaatcgtaggtacgtaggtactttagtcgttacggttaccgggaagggtacggtaaaccgaaacgggttcctacggttacccgttaccgtaagggtacccaaccggaccccgaaaaccggaccccctaaaacccccggtacgttaccg

SEQ ID NO: 307564 - DNA, 534 bp, Homo sapiens
  misc_feature: GZ8MTXP02G7KSM.39.13.B02.1.454.CMB.2.raw
  modified_base (418)..(418): a, c, t, g, unknown or other
  misc_feature (418)..(418): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatccacccaggacaaacgtccccaaatgatgatttatgagtcaactaaacggcctgtagggtttctaatcgtcttcctctgctcagtctgcacacggcctcctgacatctctggctcgagctgaggacgaggctctactattattgcagctanatatacagctattatctacgttgggtcgttcgggcgggtagggacccgtacgtacggtaccgttcgttacgtccgaacgacccgaacggtcctccgcccccgtcggtacctacccg

SEQ ID NO: 307565 - DNA, 531 bp, Homo sapiens
  misc_feature: GZ8MTXP02FXRDI.39.13.B02.1.454.CMB.2.raw
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaacgtccccaaatgatgatttatgaggtcactaaacggccctcgaggggtttctaatcgcttcctctgctcaagtctgcaacacgcctccctgaccatctctggctcaggctgagacgaggctctctattattgcagctnatatacagcattanctacgttgggtgttcgggcgggtacgggaccgtaccgtgtacccgttacgttaggtccaagtccccgaaaggtcctccgtcccccgtcggtcctacccg

SEQ ID NO: 307566 - DNA, 561 bp, Homo sapiens
  misc_feature: GZ8MTXP02I7VFT.39.13.B02.1.454.CMB.2.raw
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (428)..(428): a, c, t, g, unknown or other
  misc_feature (428)..(428): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtgttataactatgtctctgtacaacatcacccaggcaaacgtccccaaactgatgtattatgagtcactaaacgcctgagggttctatcgtctctctgctcagtctgcaacncgcctccngaccatctctggacctcgaggctgaggacgaggcctctactatttattgacagtctactataactacaanactattactcgtacgtttcgggtcggtttccggggaggttaccggggaccggtaacctcggtacccggttacgtttacggcgaaacgccccggtaaacggtcccgtccgtacccccggtccggtaccttcccg

SEQ ID NO: 307567 - DNA, 564 bp, Homo sapiens
  misc_feature: GZ8MTXP02GAL0P.39.13.B02.1.454.CMB.2.raw
  modified_base (298)..(298): a, c, t, g, unknown or other
  misc_feature (298)..(298): n is a, c, g, or t
  modified_base (459)..(459): a, c, t, g, unknown or other
  misc_feature (459)..(459): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttgtaccaacatcacccaggcaaagtccccaaactgatgattangaggtcactaaacgcctgacgggtttcaatcgcttcctctgctcaagtctgcacacggcctccctgaccatctctggctccgagctgaggacgaggtctctctattattgctagtctctaataataaccaatacctaatttaactctaacgtttgggggtntttacggggcgggtaacgggtacccggtaaaccgtcggtacccgttacgttacggtaccaacggaccccaaaggtccctaccggtccccctccgggtctaacccg

SEQ ID NO: 307568 - DNA, 541 bp, Homo sapiens
  misc_feature: GZ8MTXP02G6OSK.39.13.B02.1.454.CMB.2.raw
  modified_base (297)..(297): a, c, t, g, unknown or other
  misc_feature (297)..(297): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatgatgattangagtcactaaacgcctagagggtttctaatcgtcttctctgctcaagtctggcacacgcctcctgacatctctggctcaggctgagacgagctcgtctattatgcagctacatatacaagtctaattactctacgttgggttacgttcgggacgggtacgggacccgtaccgtacggtacccgttcgttaacgggtccaacggaccccgtaaacggtcctcgtccccgtccgttcgggttaccc

SEQ ID NO: 307569 - DNA, 537 bp, Homo sapiens
  misc_feature: GZ8MTXP02F2EP1.39.13.B02.1.454.CMB.2.raw
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatccacccaggcaaacgtccccaaactgatgtatttatgaggtcaactaaacggccctgtacgggtttcaatcgtcttcctctgctccagtctggcaacgacgcctccctgaccatctcgtggctcgagctgagcgagctntctatattgctagctacatactaacagtactattanctacgttggtgttacggcggacgggaccgtacgtcgtacccgttgtacggttaccaacgtacccgacgtccgtccgcccccgtcggtcttacccg

SEQ ID NO: 307570 - DNA, 644 bp, Homo sapiens
  misc_feature: GZ8MTXP02JX5I1.39.13.B02.1.454.CMB.2.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctgtaccaacntcaccaggcaaacgtccccaaatgatgtatttangagtcaacgtaacggccctgtagggtttctaatcgtcttccnctgctacagtctgcctaacgacggtcctccngaccctatcctcgtcgggtacctccgaggtccgtagggaacggaccggtaacggtccttacgttacttaacgtttagttcgacctacggtccttactaattaactaacgtaacgtacctaagtttactaccgttaacggtttggggtcggtttaccggggaccggggttaacggggacccctaccggttacggtaacccgttacggtttaaccggaccgtaaccggacccgtaaacgggtccctacccggtcccccgttacggtacctccccg

SEQ ID NO: 307571 - DNA, 559 bp, Homo sapiens
  misc_feature: GZ8MTXP02HR1S6.39.13.B02.1.454.CMB.2.raw
  modified_base (224)..(224): a, c, t, g, unknown or other
  misc_feature (224)..(224): n is a, c, g, or t
  modified_base (360)..(360): a, c, t, g, unknown or other
  misc_feature (360)..(360): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcttggtaccaaacatcacccaggcaaagtccccaaactgatgatttatgagtcactaaacggcctcgtagggtttctaatcgcttcctctggctcagtctggcaacncgcctccctgaccatcctcgtcgggctccgaggctgaggacgagcgtctctaattatgcagtctcatactacagctattatctagttgggtcgtttcgggacgggtacgggacccgtaccgttcggacccgtttccgttaacggtcgaaccggtacccgaaacggtccgtccggccccccgttcgggttccctaccccg

SEQ ID NO: 307572 - DNA, 520 bp, Homo sapiens
  misc_feature: GZ8MTXP02FGZBH.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcttggtaccaacatcacccaggcaaagtccccaaactgatgatttatgaggtcaactaaaacggccctcgaggggtttcaatcgcttcctctggctccaagtctggcaacacggcctccctgaccatctctgggctccagctgagacgaggctctctattattgcagctcatatacaagctattatcaactttgggtgttcggcggtagggaccgaccgtcgaccgtctacggtcaacgcccaaggcctcgcccctcggtctaccg

SEQ ID NO: 307573 - DNA, 563 bp, Homo sapiens
  misc_feature: GZ8MTXP02F4HXW.39.13.B02.1.454.CMB.2.raw
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccagggaaggggctggagtgggtctcatccattagtggtgccagtggtggtaatacatattatgtgactcgtgaggccgtcacatcnccaganacaattccaagaacactctgtatctgaccaaatgaacagcctgagcgccgagacacgcctatatactgtgacgaatctcccgacttgacgttcgccacctaacttcgaccgtccgtcggggccgacgggtaacccgtcggtaccacccgtctcctcacgccctccaacccgaacggcccacgtcccggttcccttcccccgtcggccctacccctccctaccaacgacgaccaccgtcgtcgggggcacgaccgg

SEQ ID NO: 307574 - DNA, 676 bp, Homo sapiens
  misc_feature: GZ8MTXP02HWG9T.39.13.B02.1.454.CMB.2.raw
  modified_base (210)..(210): a, c, t, g, unknown or other
  misc_feature (210)..(210): n is a, c, g, or t
tcagtcgcactagtcacgaccggtgctcgatttagtctagcgactttgggctgagctgcctttttcttgtggctatgttaaaaaggtgtccagtgtgaggtgcagctgttggagtctgggggaggcttggtacaggcggggggggtccctgagactctcctgtacagtctctggattcagctttagcacctatgccatgagctgggtccnccaggctccgaggggaagggctggagtgggtctcatccattagtggtgccagtggtggtaatacatatatgtgactcgtgaggtccgttcacatctacagagacaattaccaagaacactctagtatctgaccaaaatgaacagctgagccgacgagtacaccgtcctagtacttactgtgacgtaaatcctacccgtactttggtaggtttacgaccctaaccctaactttcgaaccgttcccggtcgggggaccccgtaacggggtaacccctgggtaccccgtacccggttcctcccgtaccaccggtcccctacccaacccggtaaaccggccccctacgttccccggttacccttccccccgttacgggaccccctaaccccctttccccgtaacccgaaaccggtaccgacccgtaaccccgttaccggggtccgggggaccctaaaccggtccccgggg

SEQ ID NO: 307575 - DNA, 670 bp, Homo sapiens
  misc_feature: GZ8MTXP02H483J.39.13.B02.1.454.CMB.2.raw
  modified_base (268)..(268): a, c, t, g, unknown or other
  misc_feature (268)..(268): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcaccatctcctgcactacggaaccagcagtgtacgtttggtgttaataactatgtctcttggtaccaanactcaccagaccaaacgtccccaaatgatgtattagtgagtacaactaaacgtcctacgtagggttactaagtccgtacttccctctcggtctacctaagttcgtacggccaaaccgtccggcccttaccctagaccctattccctccgttcgggccttaccgaggtcgtacggaacggtacgacggtcctcgttacttattactgactacgtcctataactaacgtaacaacgtacttaacttactaccgttacggtttcggggtcggtttacggggacccggggtaaccggggtacccgtaaccggttcggtacccgtttacgttaccggtaccgaaccggttaaccccggtaacggccccgttacccggtccccccggtaacggttcccttaaccccgg

SEQ ID NO: 307576 - DNA, 551 bp, Homo sapiens
  misc_feature: GZ8MTXP02FSXOU.39.13.B02.1.454.CMB.2.raw
  modified_base (222)..(222): a, c, t, g, unknown or other
  misc_feature (222)..(222): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcaggcacagggtcctgggcccagtctgccctgactcagcctgcctccgtgtctgggtctcctggacagtcgatcaccatctcctgcactggaaccngcagtgacgttggtgttataactatgtctcttgtaccaacatccaccaggacaaacgtccccaaactgatgattatgaggtcaactaaacggccctagtagggtttctaatcgtcttcctctgctacaagtctggcaacncgcctccncgacatctctggctccgagctagagacgagcttctactattagttgactagcttacattaatacaatctaatttactctaacggtttggtacgtttacgggcgggtacgggtaccgaaccgttcgtacccgttcgtacggttacaacgtccctaacggtctccgtcccctcggtcctaccg

SEQ ID NO: 307577 - DNA, 585 bp, Homo sapiens
  misc_feature: GZ8MTXP02FSTZ9.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttaataactatgtctcttggtaccaacatcacccaggacaaacgtccccaaactgatgtatttatgtaggtcaacgtaaaccgcctcgtagggtttcaatcgcttcctctgctcaagtctggcacaccggtcctccctgaccatctctcgggcctcgaggctggacggacggaggcttctactatttattgcagtctacattactacgaagtctattactactacggtttggggtacggttccgggacggggtacgggtacccgtaccgttacggtacccgttacgttacggtaccaacggacccgaacgggtccttacccggcccccggttccggtccttacccg

SEQ ID NO: 307578 - DNA, 559 bp, Homo sapiens
  misc_feature: GZ8MTXP02JY9Q8.39.13.B02.1.454.CMB.2.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctntgtacaacatcaccagacaaacgtaccccaactgatgtatttangagtcaactaacgcctcgtagggttctaatcgtcttcctctgctaccagtctggcaacgaccggtcctccctcgacctactctcgtcggctccgaggctgacggacgacggctctcttattatgcagctcactatacaagtctattactctacgttgggtcgttcgggcgggtacgggaccgtaccgtcggtaccgttacgttacgggtaccaacggtcccgaacgggtcctacccggtcccccgttacggtaccctacccg

SEQ ID NO: 307579 - DNA, 555 bp, Homo sapiens
  misc_feature: GZ8MTXP02HGA1Q.39.13.B02.1.454.CMB.2.raw
  modified_base (223)..(223): a, c, t, g, unknown or other
  misc_feature (223)..(223): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttaataactatgtctcttggtaccaacatccacccaggacaaacgtacccccaaatgaatgtatttataggaaggtacaacgtaaaaccggcccttacgtacggggtttactaagtcgtcttcctcgtcgctaccgaagtcgtggccaacgacggtccctcccgtacgaccactcctcgtcggcctccgaggctaggacggacgaggctctactattatgcagctanatananananatatatagtggtggtcggacggacggacgacgtacgtacgtacgtacgacgaacgaccgacgcgccgcccgtccgtactc

SEQ ID NO: 307580 - DNA, 560 bp, Homo sapiens
  misc_feature: GZ8MTXP02FUGS2.39.13.B02.1.454.CMB.2.raw
  modified_base (260)..(260): a, c, t, g, unknown or other
  misc_feature (260)..(260): n is a, c, g, or t
  modified_base (428)..(428): a, c, t, g, unknown or other
  misc_feature (428)..(428): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctgtacanatcaccagcaaacgtccccaaatgatgtattatgaggtcactaaacgccctcgtagggtttctaatcgtcttcctctgctcaagtctggcaacacggcctccctgacactctctggctcgagctgagcgaggctctactattattgactagtctcaattaactacaanctattactcgtaacgtttgggtcgtttcgggacgggtagggacccgtaccgtacggtacccgttacgttacggtaccaacggaccccgtaaacggtcccgtacccggtcccccgttacggtacccttcccgg

SEQ ID NO: 307581 - DNA, 553 bp, Homo sapiens
  misc_feature: GZ8MTXP02IUVWZ.39.13.B02.1.454.CMB.2.raw
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagcagtgacgttgtggtataactatgtctctgtacacatcaccagacaactacccaactanatatattatgagtacactaaacgcctctagggttatacnctcttcctctgctaccagtctgacacacgccctccctgacatctcgcggcctcacggctgacggacgacggtcttacctntaatttagtntccgtaatctactataactaaagacgacttattaatccgtagtgggttcgtcgggacgggacggtaccgcccgttcggtaacgttcggttacgtacgaacgtaccccggaagtccctccgcccccgttaggtaccctaccg

SEQ ID NO: 307582 - DNA, 784 bp, Homo sapiens
  misc_feature: GZ8MTXP02I0GMX.39.13.B02.1.454.CMB.2.raw
  modified_base (224)..(224): a, c, t, g, unknown or other
  misc_feature (224)..(224): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctctgcactggaaccngcagtgacgttggtgttataactatgtctctgtaccanatcaccaggacaacgtccccaaatgatgtatttagngaggtcaacgtaaaccggccctacgtacggggtttactaagtcgtacttccgtcgtcggtctacctaagttccgttacgggacctaaaccgtaaccgggtccccttaccccgtacggaccctaacttcccgttaccgtcgggggtacccttcccgtaaacggggtccttacgggaaacggggtacccggtaacggggtcccctttacggtaccgttaagttttaacgttcggtaccctaacgggttccttaccggtaacgtttaaactaaaccgtaaacggttacccgttaagtttaaacctccggtttaaaccggttttcgggggtttacggttttaacccgggggacgggggttaaaccggggtacccggttacccgttacgggttaaccccggttacggtttaaccgggggtacctaacgggtacccccgtaaaaggggtaccccttccggtaccccccgtttcgggtaccctttaaccccgg

SEQ ID NO: 307583 - DNA, 609 bp, Homo sapiens
  misc_feature: GZ8MTXP02IBK7O.39.13.B02.1.454.CMB.2.raw
  modified_base (368)..(368): a, c, t, g, unknown or other
  misc_feature (368)..(368): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccatctcctgcactggaaccagcagtgtacgttggtagttataactatgtctctgtacaacactcaccaggaccaaacgtaccccaaatgatgtatttataggagtacaacgtaaacggcccttagtaggggtttactaagtcgtacttcctctcgctcgaagtcgngtccaaaccgtacgcccctccctagacctactctccgtcgggccttccgacggtcgtgaacgggacggaggtcctcttacgttattacttgctagtctacataatacaagtctatacttcgtacgtttggggtcgttacgggacggggtacggaccttaccggtacgtacccgtttacgttaccggtccaaccggtacccgaacggtccgtaccccgtcccccgtacggttcctaaccccg

SEQ ID NO: 307584 - DNA, 555 bp, Homo sapiens
  misc_feature: GZ8MTXP02F359Z.39.13.B02.1.454.CMB.2.raw
  modified_base (303)..(303): a, c, t, g, unknown or other
  misc_feature (303)..(303): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatccacccaggcaaacgtccccaaactgatgatttangagtcaactaaacggcctagtagggtttcaatcgtcttcctctgctaccagtctgcaacacggtcctcctcgaccatctcgtcggctccgaggtctaggacggacgaggccttcgtacttattattcgctagctacatatacaagctatatctagttgggtgttcggacgggacggacccgtacgtcgtaccgttcgttacggtacaacgaccccgaagggtccctccggtcccccgtacggtacctacccg

SEQ ID NO: 307585 - DNA, 544 bp, Homo sapiens
  misc_feature: GZ8MTXP02GICKL.39.13.B02.1.454.CMB.2.raw
  modified_base (424)..(424): a, c, t, g, unknown or other
  misc_feature (424)..(424): n is a, c, g, or t
tcagtcgcactagtcacgaccggtgctcgatttagtctagcgacttccgcgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcttgtaccaacatcaccaggcaaacgtccccaaactgatgatttatgaggtcactaaacggcctcgtagggtttctaatcgtcttcctctgctacagtctgcaacacggcctccctgaccatctctggctcagctgagacgaggctctatattatgtcagctcatatacaanctattatcactttgggtcgttcggacgggtagggacccgaccgtcggtacccgttacgttacggtactaacggacccccgaaaggggtccctccgccccccgttcgggttaccctacccg

SEQ ID NO: 307586 - DNA, 566 bp, Homo sapiens
  misc_feature: GZ8MTXP02GBLN9.39.13.B02.1.454.CMB.2.raw
  modified_base (265)..(265): a, c, t, g, unknown or other
  misc_feature (265)..(265): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaanatcaccaggcaaacgtccccaaatgatgtattatgagtcaactaaacggcctacgtagggtttactaatcgtcttcctcgtggctaccaagtcctaggccaaacgaccggtccctcccgtagaccatctcgtcgggcctccgaggctggacgacgaggtctctactattatgctagtctcatanaacaagtctaatttancgtacgttgggtcgttcgggacgggtacgggacccgtaacgtcggtaccgttcgttagccgaacgcccgaaggtccctccggtcccccgtcggtcctaccg

SEQ ID NO: 307587 - DNA, 591 bp, Homo sapiens
  misc_feature: GZ8MTXP02JT5M1.39.13.B02.1.454.CMB.2.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctgtaccaacactcacccaggacaaacgtaccccaaatgatgtatttangaggtacaactaaacggcctagtagggttctaatcgtcttcctctgctccgagtcgtcggcaacgaccggccctccctgacctactccgtcgtcggggtcctcccgaggtcgtaggacggaccgacggtcctcttacttaattagttcgctagtccttacattacaaccaagtactattactacgtacgttggggtcggttaccggggacgggtacgggacccgtacgtacgtaccgtacgttaacggtcgaacgacccgaaggtcctccgtccccgtcggtacctccg

SEQ ID NO: 307588 - DNA, 546 bp, Homo sapiens
  misc_feature: GZ8MTXP02IUTXE.39.13.B02.1.454.CMB.2.raw
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
tcagtcgcactagtcacgaccggtgctcgatttagtctagcgacttccgcggggggtctcagaaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccacatcacccaggcaaagtccccaaatnatgatttatgaggtcactaaacggccctnagggtttctaatcgcttctctgctcaagtctgcacacgcctcctgaccatctctgggctcccgaggcctaggaggtacgagggcctccgtacttatttattcgcaagtctcataactacaagctattactctaacgtttgggtcgtttcgggcggaacgggtcccgaccgtcgtaaccgttcttaacgggtcaacgcccaacggcctcgcccccttacggtcctaccg

SEQ ID NO: 307589 - DNA, 533 bp, Homo sapiens
  misc_feature: GZ8MTXP02JF6UU.39.13.B02.1.454.CMB.2.raw
  modified_base (405)..(405): a, c, t, g, unknown or other
  misc_feature (405)..(405): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatcgatgatttatgaggtcactaaaacggccctcaggggtttctaatcgcttcctctggctccaagtctgcaacacggcctccctgaccatctctgggctcaggctgagacgaggctcnctattattgacacgtctacctataacttaaccgaaagtcctaattactactaacgttgggtgtttcgggcgggacggtaccgacgtgaccgttcgtagtcaacgccaaggtcacgccctcggctaccg

SEQ ID NO: 307590 - DNA, 548 bp, Homo sapiens
  misc_feature: GZ8MTXP02HSS0V.39.13.B02.1.454.CMB.2.raw
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtagttataactatgtctctgtaccaacatcacccaggacaacgtaccccaaactgactgatttatgagtacaacgtaaacggcctcgagggtttactaagtcgtcttctcgtgctccaagtctaggccaaacgaccggcctacccgtgaccatctcgtgctcagctgaggacgaggctacgtactattattcgnagtctacataactanaagctatatctagttggtggttcggacgggtacggaccgtacgtacggaccgttacgtacgtcgaacgtccgaaacgtcgtacgtacccgtcgttccggtacc

SEQ ID NO: 307591 - DNA, 642 bp, Homo sapiens
  misc_feature: GZ8MTXP02F0JBT.39.13.B02.1.454.CMB.2.raw
  modified_base (354)..(354): a, c, t, g, unknown or other
  misc_feature (354)..(354): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagtggggggggtccctgagactctcctgtacagtctctggattcagctttagcacctatgccatgagctgggtccgccaggctccgagggaaggggctggagtgggtctcatccattagtggtgccagtggtggtaatacatattatgtggactccgtgaagggccgttcaccatctcagagacaattccaaagaacactctgtatctgaccaaaatgaacngcctgagcgccgaggacacgcctatattactgtgacgaaatcgtacccgtacgttggtacggtttcgaccctacctaaactttcgaaccgttcccgtacggggacccgaacggggtaaccccttacgggtacctaacccgttccttcccgttaccgacggtcccctacccgaacccgaaaccgggcccctacgttcccggttccctttccccccgtcggtacccctaccccctccctacccgaaacgtaccgaccgtacccgtccggtacgggggaccacgacccggg

SEQ ID NO: 307592 - DNA, 615 bp, Homo sapiens
  misc_feature: GZ8MTXP02H6QZJ.39.13.B02.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (456)..(456): a, c, t, g, unknown or other
  misc_feature (456)..(456): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggngttataactatgtctcttggtaccaacatccaaccccaggaccaaaacgtacccccaaatcgaatgtatttanaggtaggtaccaaccgtaaaacgggtcccttacggtaggggtttactaaactccgtcttcccctcgtcggtcctactaaagttcgttacggcctaaaccgaccggtcccttccctacgaccatcctcgtcgggcctccgaggtccngaggacgacggctcttctattattgcaagtctactataactacaagtactattataccgtagttgggtcggttcggacgggtacgggaccgtaccgtcgtaccgttcgtacggtccaacggccgaaacgggtcctccggcccccgttcggtacctcccg

SEQ ID NO: 307593 - DNA, 603 bp, Homo sapiens
  misc_feature: GZ8MTXP02INA7N.39.13.B02.1.454.CMB.2.raw
  modified_base (299)..(299): a, c, t, g, unknown or other
  misc_feature (299)..(299): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtgttataactatgtctctggtaccaacatcacccagcaaacgtccccaaatgatgatttangagtcactaaacggccctcgagggtttctaatcgtcttcctctgctcaagtctgcaacacggccctccctcgacctatctactagacctccaggctaggacggacgaggctagacttattattgacagctcatactactagaacgttcaaagttgtactaccgtaacgttcgggtcttaggggttccgggacggggtaacgggaccgttaaaacgggtttccgtaaaccccggtttccgttaacgggggttaccctaacgggacccccgtaaaaggggtcccgttccccggttaacccccccgg

SEQ ID NO: 307594 - DNA, 564 bp, Homo sapiens
  misc_feature: GZ8MTXP02IC3X7.39.13.B02.1.454.CMB.2.raw
  modified_base (253)..(253): a, c, t, g, unknown or other
  misc_feature (253)..(253): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagtcgcactagtcacgaccggtgctcgatttagtctagcgacttccgcgggggggtctcaggaggcagcgctctcaggacatctccaccatgacctgggctctgctgctcctcaccctcctcactcagggcacagggtcctgggcccagtctgccctgactcagcctgcctcgtgtctgggtctcctggacagtcatcacatctcctgcactggaaccagcaggtgacgttggtagttataactatgtctntggtacaacatcaccaggacaagtaccccaaatgatnattangaggtcaactaaacggcctacgtagggtttactaagtcgcttcctctgtctctaagtctggccaacacggtccctcctcgaccattctcgtcgggctacgagtctgacggacggtacgctctctagttattgcagtctactataactacgaatctattaacttctacgttggggtcgtttacgggcgggttacgggaccgtacgacgtaaccgttcgttaacgggtcaacggtccaacggtcctacccgtccccgtacggtcctacccg

SEQ ID NO: 307595 - DNA, 541 bp, Homo sapiens
  misc_feature: GZ8MTXP02JNMJ5.39.13.B02.1.454.CMB.2.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataacatgtctcttgtaccaanatcacccaggcaagtccccaaatgatgattatgagtcaactaaacggccctgtagggttactaatcgtcttcctctgctacaagtctggcaactacggccctccctgacctactctcgtgggcctcccgaggctagagcgagtctcgtctattatgcngtctnattanacagctattanctagttgggtgttcgggacggacggtaccgacgttcggaccgttcgttaggtaccgaacgacccgtaacgggtcctaccggcccccgtcggtcctacccg

SEQ ID NO: 307596 - DNA, 635 bp, Homo sapiens
  misc_feature: GZ8MTXP02JJEYU.39.13.B02.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (381)..(381): a, c, t, g, unknown or other
  misc_feature (381)..(381): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaaccngcagtgacggttggggtangactatgtctctggtaccagcaatatccaggcacaccgacccccaaatcatctattatgagtcaagtaactccggccgtgtacgggtttactaacgtccgtcttcctgtcggctacctagtcgtacgaccgtaaccnccggcccttcccgtacgaccctatccgtcgtcggcctaccggagtccgtaggaacggtacgaggtacttaggtaatttactacgtgacctacgtctacttagttacgactaactaccgtaggtacggtacggttacgtttaacggttcggttaaaccggtttagggggtaaacggttaccggggtaacccgtaaagggtcctaacggttccgttacggtacggtaccgaccggtaacccgtaacggaacccccg

SEQ ID NO: 307597 - DNA, 529 bp, Homo sapiens
  misc_feature: GZ8MTXP02GLP4E.39.13.B02.1.454.CMB.2.raw
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatccaccaggcaaacgtcccccaaatgatgatttatgtagttctttcgtcgccctgtaggggtttctagtcgtcttcctccgctcagtctgcacncgcctccngaccntcnctacgctccagctgagacgagctgactattatgcagctnatatactagaagtcaatggtactccgtatggtctggttcggacgggacgggacctaaggttacgaccgttacgtaaggtcacggacccgaacggtcctccgcccccgttacgg

SEQ ID NO: 307598 - DNA, 548 bp, Homo sapiens
  misc_feature: GZ8MTXP02IXILG.39.13.B02.1.454.CMB.2.raw
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
  modified_base (448)..(448): a, c, t, g, unknown or other
  misc_feature (448)..(448): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctctggacagtcgatcaccatctcctgcactggaaccagcagtgacgttggtgttataactatgtctcttgtaccaacatccaccaggacaaacgtaccccaaatgatgattangagtcactaaacgcctgtagggttctatcgtcttcctctcgctcaagtctgcaacncgcctcctgaccatctcgtggcctcgaggctgaggacgaggctcgtactattatgacagctacagtatacgtgaagtactaagtcgtactaccgngtacggtcttacggtcgggacgggaacgggtaacctaaacggttcggtacccttaacggtacgtaccgaccgaccccgtaaggcccgtaccgtcccccgg

SEQ ID NO: 307599 - DNA, 602 bp, Homo sapiens
  misc_feature: GZ8MTXP02IOILK.39.13.B02.1.454.CMB.2.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctcctgcactggaaccngcagtgacgttggtgttataactatgtctcttgtaccaacatcaccaggcaacgtccccaaatnatgatttatgagtcacgtaaacggccctagtagggtttactaagtcgtcttcctctcggctacctaagtccttggcaacgaccggtccctccctcgaccatcctcgtggcctccgaggctagaggacgaggcttcgtactattattcgacagtcctactataactacaaagtactaatttactaccgttacgttggggttacggttacggggacgggtaacggggacccgtaaccgtacggtacccgttacgtttacggtaccgaacggaccccgtaaacggtcccgtccggtacccccgttcggtaccctacccg

SEQ ID NO: 307600 - DNA, 636 bp, Homo sapiens
  misc_feature: GZ8MTXP02IKFWG.39.13.B02.1.454.CMB.2.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatcctctgcactggaaccngcagtgtacgttggtagttataactatgtctcttggtaccaacatacaccaggacaaacgtaccccaaactgactgatttatgagtacaactaaaacgccctacgtaggggttactaagtcgtcttccnctgctcaatctgcacacgcctcctcgacatctcgtgctacgcgcgtagacggacgaggctacgtacttacgttattcgacgtatctactaactaactaacgaaacgtacctaatttaactaccgttaacggtttcgggggttagggtttaccggggaccggggttaaccggggaaccccgttaaaccgtccggttaacccggtttaccgtttacgggttacctaaccgggacccgtaaacgggtcccgttaccgtccccgttaccccgttacggtttacccccg

SEQ ID NO: 307601 - DNA, 537 bp, Homo sapiens
  misc_feature: GZ8MTXP02FPAZ4.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaaacggccctcaggggtttctaatcgcttcctctgctccaagtctggcaacacggcctccctgaccatctctgagctccaggcctgaggacgaggctctctattattgcagctcatatacaagctattatctacgttgggtcgtttcgggacgggacggggacccgaccgttcgacccgttacgttacggtcaacggcccaaagggcctcggcccccgtggtacccc

SEQ ID NO: 307602 - DNA, 767 bp, Homo sapiens
  misc_feature: GZ8MTXP02H5707.39.13.B02.1.454.CMB.2.raw
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatcctcctgcactggaaccagcagtgtacgttggtgttaataactntgtctctggtaccaacatccaccaggaccaaacgtcccccaaatgactgtattagagacggtcaacgtaaacggccctagtagggtttactaatcgtctttcccncgttaggccctacgtaagtcgtacggaccaaaccgaccggcccttaccccctagaaacccctattccgtcccgttcggggaccttccccgaagggttcccgagggtaacggggtaccgaacgggtccttccgttaccttaagtttaaacgtttcggacctaggttaccgtacctaaaacgtttaagttaaacaaaacggtaccttaaactttaagttacccggtttaaacggtttgggggttaaccgggttttacccgggggacgggggttaaccggggtaaccccggtaacccggttaccgggtaaaccccggttttaccggttaacgggttacccgtaaccggtacccccgaaaaggggttccccgttaccggttacccccgtacccggtttacccggtttacccccg

SEQ ID NO: 307603 - DNA, 594 bp, Homo sapiens
  misc_feature: GZ8MTXP02GC83U.39.13.B02.1.454.CMB.2.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcggggggggtcctgagactctcctgtacagtctctggattcagctttagcacctatgccatgagcgtgggtccgccaggctccgaggggaagggctggagtgggtctcatccattagtggtgcagtggtgtaatacatattangtgactcgtgaaggccgtcacatcncaganacaatccaaagacatctagtatctgacaaatgaaacncgctgagcgcgagacacgcctatatactgcgacgaaactctacccgtagtttacgtacggtttcgaccctaacctaactttcgaccgttccggtcggggaccgaacgggtacccttacgggtaccacccgtcctcctcgacgtccctacccacgaaccggaccctacgttccggttcccttccccgacggcccctaacccctccctaccgaacgaccgtccgaccgtccggcgggggaccacgaccggg

SEQ ID NO: 307604 - DNA, 587 bp, Homo sapiens
  misc_feature: GZ8MTXP02HXA87.39.13.B02.1.454.CMB.2.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
tcagtcgcactagtcacgaccggtgctcgatttagtctagcgacttccggcgggggggtctcaggaggcagcgctctcaggacatcctccaccatggcctgggctctgctgctcctcaccctcctcactcagggcacagggtcctgggcccagtctgccctgactcagcctgccctcgtgtctgggtctcctggacagtcgatcaccatctcctgcactggaaccngcagtgacgttggtgttatactatgtctcttggtaccaacataccaccaggacaaacgtccccaaactgatgtatttagngagtcaactaaacgcctcgtagggttctaatcgtcttcctntcggctccgagttctggctaacaccggcctcccgtagacctatctcgtggctccgaggctgaggacgaggtctcgtctattattcgctagtctacatactacaagtactacttatacgtacgtttcggggtcggtttacgggcgggaacggggacccgaccggttacgtacccgtacgttacggtacgtaacggcccgtaaacggtccgtaccgtacccccgttcggtacccttacccgg

SEQ ID NO: 307605 - DNA, 538 bp, Homo sapiens
  misc_feature: GZ8MTXP02IZUJL.39.13.B02.1.454.CMB.2.raw
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
  modified_base (516)..(516): a, c, t, g, unknown or other
  misc_feature (516)..(516): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctccngcactggaaccagcagtgacgttggtgttataactatgtctcttggtaccaanatcacccaggacaaacgtacccccaaatgatgatttatgaggtcactaaaaccggccctcgtaggggtttctaatcgtctttcctctgctcagtctgcacncgcctcccngaccntctctggctcaggctgaggacgaggctcgtacttattattgcagtctcatanacagctattatctacgttggtcgttcggacggacgggaccgtaccgtcggtaccgttcgttcgtacaacgacccgaggtacccncgtcccccgtggtaccctaccg

SEQ ID NO: 307606 - DNA, 563 bp, Homo sapiens
  misc_feature: GZ8MTXP02IH9WE.39.13.B02.1.454.CMB.2.raw
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcgatcaccatctcctgcacgtggaaccagcagtgtacggttggtagttaataactatgtctctgtacaacatcaccaggacaacgtaccccaaatgatgtattatgagtacactaaacgcctagtagggtttacaatcgtcttctcgtcgctacagtctgctacacgccctcctgactatctcgtggcctcgaggtctagaggacgaggtctcgtactatttagttgacagtactacagttaacaccgaatacttagtttaactccgttaagttggggttcgttacggggacgggtacgggacccgtacgtacgtaccgtacgtttacgacgaacgtaccgacgtccgtcccgccccttcggactcccg

SEQ ID NO: 307607 - DNA, 586 bp, Homo sapiens
  misc_feature: GZ8MTXP02FHQU0.39.13.B02.1.454.CMB.2.raw
  modified_base (353)..(353): a, c, t, g, unknown or other
  misc_feature (353)..(353): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccaggggaaggggctggagtgggtctcatccattagtggtgccaggtggtggtaatacatattatgtgactccgtgaaggccggttcaccatctccagagacaattccaaagaacactctgatctgaccaaatgaacngcctgagcgccgaggacacggaccctatacttactgtgacgaaatcctcccgacttgaggtttgcccacctaaactttgaacctccgtacgggggtcccgacggggaaccccttgggtaccacccgttcctccctcgacgcctcccaccgaacgggcccactccggtccttcccccgtcggcctacccctcctaccaacgacgacctacccgtcgtcgggggaccacgaccgg

SEQ ID NO: 307608 - DNA, 745 bp, Homo sapiens
  misc_feature: GZ8MTXP02G6Q3P.39.13.B02.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctntgtacaanactcaccagacaaacgtaccccaaatgatgtattangagtcaactaacgcctagtacgggttctaacgtcgtcttcctcgtcgtctaccgaagtctacgggaccaaaccgtaccggccccttccccgtacggtaaccctacgttccgttcccggtcgggggtcccctttacccggagggtacccgttagggaaacggtttaacccgggaacggggtcccctttaccttaaccggtttaaagttttaactttcgggaccttaaacggtccttaaccgtaagtttaaacttaaccgttaagtaaaacggttacctaaaaggtttcgggttaacttaccgtaaccggttggtacccggtttgggtttacccggggaacggggtaaacggggtaaccgttaaacgggtttccggtaacccggttaaccggttaacggttaccgaaccggtaccccgaaaacggtccccgttaaccggttcccccccgg

SEQ ID NO: 307609 - DNA, 660 bp, Homo sapiens
  misc_feature: GZ8MTXP02J25TM.39.13.B02.1.454.CMB.2.raw
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtgttaataactatgtctnttgtaccaacatcacccaggacaaacgtaccccaaactgatagtatttangtaggtacaaccgtaaacgcctacgtagggtttactaactcgtcttcctcgtgcctaccaagtctaggccaaacgaccggtccctaccctgaccctatcctcgtacgggctcccgaggtccgtagacggggacaacgggtcctaccgttacttaagtttacgttcggacctaacgtccttactaagtttaaactaaccaaagttacctaaagtttaactaccgttaacgtttcgggggtcggtttaccggggacgggtaaccggggacccgtaccgttacggtaccgttacgttacggaccgaacggaccccgaaacggcccgttacccggcccccgttacggtacccttcccg

SEQ ID NO: 307610 - DNA, 576 bp, Homo sapiens
  misc_feature: GZ8MTXP02FMIRF.39.13.B02.1.454.CMB.2.raw
  modified_base (297)..(297): a, c, t, g, unknown or other
  misc_feature (297)..(297): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacagtgggggggtccctgagactctcctgtacagtctctggattcagctttagcacctatgccatgagctgggtccgccaggctccgaggggaaggggctggagtgggtctcatccattagtggtgccagtggtggtaatacatattatgtggactcgtgaggcgtnacatctcagagacaattccaagaacactctgtatctgaccaaatgaacagctgagcgcgaggacacgcctatatactgtgacgaaatctaccgacttgaggtttcgacctacctaactttcgactccgtcggggaccgacgggaaccctcgggtaccacccgtctccctcgtacgcccgtccaacccgaacggaccccacgtccggtcccttcccccgtcggccctacccctccctacccaaacgaccgaccacccgtccgtcggggacgaccgaccgg

SEQ ID NO: 307611 - DNA, 498 bp, Homo sapiens
  misc_feature: GZ8MTXP02GTJ5R.39.13.B02.1.454.CMB.2.raw
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcttggtacaacatcacccaggcaaagtccccaaactgatgatttangaggtcactaaacgcctcagggttctaatcgcttctcngctccaagtctggcaacacggcctccctgaccatctctgggctccagctgaggacaggctntctattatgcagctnactaanacanctatacntagtggtcgtcggcggacggaccgacgtcgtaccgtcgtacgcaacgccgacgctcgccctcgtctcg

SEQ ID NO: 307612 - DNA, 749 bp, Homo sapiens
  misc_feature: GZ8MTXP02H6AWD.39.13.B02.1.454.CMB.2.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (329)..(329): a, c, t, g, unknown or other
  misc_feature (329)..(329): n is a, c, g, or t
tcagtcgcactagtcacgaccggtgctcgatttagtctagcgactttgggctgagctgcctttttcttgtggctatgttaaaaggtgtccagtgtgaggtgcagctgttgggagtcgtggggggaggcttggtacaggcggggggggtccctgagactctcctgtacagtctctggattcagtctttagcactatgcatgagctgggtccncaggctcgaggggaagggntggagtgggtctcatcattaggtggtgccgtaggtggtaggtaatacattattatggtgactcggtaggaacgggtccggttcaccatcctaccaaganaacaaattaccaaagaaactactctagtaactcgtagaaccaaaagtacgaacacgctaggacggccgaccgggaacggaaccgaccggtaccctaagttacttaacgtcgtacgaacgtaaacttcccgtacccgtagtttaggttacggtttacgtaccctaaacccttacgtttacgtaacccgttccgggtaccgggggtacccgtaaccggggtaacccgtcgggttaccctacccggttccccgtaccgtacccgacccgtacccccgttacccgaaacccggtaaacccgggtaccccctaccggtttccccggttcccccttcccccggtcggaccccctacccccgtcccgtacccgaaaccggaccgacccgtacccggtccgggtaccgggggacccaaccggcccggg

SEQ ID NO: 307613 - DNA, 642 bp, Homo sapiens
  misc_feature: GZ8MTXP02FRI44.39.13.B02.1.454.CMB.2.raw
  modified_base (266)..(266): a, c, t, g, unknown or other
  misc_feature (266)..(266): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtgacagtcgatcaccatcctcctgcactaggaaccagcagtgacggttggtagttataactattgttctgtacanactcaccagacaaacgtccccaatgatgtattatgagtacacgtaaaccgtccctgtagggttactaagtcgtacttctcctggtcctacgtagtctaggaccaccgtccgtccctccgtacgtaacctcgtccgtcgtcggacctacggacggtcgtaggaacgggtacgacggtactctacttatagttcgactatcctatattacaactaacgtcttaattacgtacgttaggttagggttacgggtcgggaacggtacggggaacccgttacgtacgggtaacccgttggttaaacggtcctaacccgggaacccgtaacggtccccgttcccggggtaccccctttcggtaacccgtaccgtttacccccg

SEQ ID NO: 307614 - DNA, 579 bp, Homo sapiens
  misc_feature: GZ8MTXP02JMKTC.39.13.B02.1.454.CMB.2.raw
  modified_base (295)..(295): a, c, t, g, unknown or other
  misc_feature (295)..(295): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctctgtaccacatcaccagcaacgtccccaaatgatgatttangagtcactaaacggccctgtaggggtttactaatcgtcttcctctcgctccaagtctggcaacgacggcctccctgacccatcctcgtgggctccgaggctggagacgaggcctctacttattattgacgatctacatataacaagctaattactctaacgttggggtcgtttcgggacggggtaacggggaccccgtacgtacggtaccggttaccgtttacggaccgtaaccggaccccgtaacggtccgttacccgccccccgttcgggtaccctacccgg

SEQ ID NO: 307615 - DNA, 694 bp, Homo sapiens
  misc_feature: GZ8MTXP02HR466.39.13.B02.1.454.CMB.2.raw
  modified_base (211)..(211): a, c, t, g, unknown or other
  misc_feature (211)..(211): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
tcagtcgcactagtcacgaccggtgctcgatttagtctagcgactttgggctgagctgccttttttcttgtggctatgttaaaaggtgtccagtgtgaggtgcagctgttggagtctggggggaggcttggtacaggcggggggggtccctgagactctcctgtacagtctctggattcagctttagcacctatgccatgagctgggtccnccaggctccgaggggaaggggctggagtgggtctcatccattagtggtgccaggtggtaggtaatacatattangtggactccgtaggagggccgttcaccatcnccagagacaattccaaagaacactctgtatctagaccaaaatgaacagctagagccgcgagaccacggcctatatctgtgacgtaaactccgtcccgtacttggtacggtttcgaccctaacctaacgtttcgaccgttccggttcgggggacccgtaacggggtaaccccttcggggtacccctacccggtcccttccccgtacgtaccgtccccctaccccgaaaccccggaaaacccggggtccccctaaccggttccccgggtttacccccgtttccccccgtccgggtacccccgtaccccccgttacccctaacccgaaacgtaaccgccccgtaacccggttccggtcgggggacccaaccggccccgggg

SEQ ID NO: 307616 - DNA, 694 bp, Homo sapiens
  misc_feature: GZ8MTXP02HYONM.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatccacccaggaccaaacgtacccccaaactgatagtatttaatggaggtacaaacgtaaacccggtccctacgtaggggtttacctaaagtcggtctttccgtacgttcgggtaccttaccgtaagttccgttacgggaccaaaccgtaacccggtcccccttacccccgtacggtaaccccaactttcccgtccgttcggggcccttacccgacgggtctagggaacgggtaccggtaacgggtcccttccgttaccttaatttaacgtttcgcgtaacgtcttaccaattaactaaccaagtctaattatcgtaacggtttgggttcggttaccgggcgggacgggacccgtaccgtacgtaccgttacgtttacgaccgaacgtacccgaacggtccgtaccgtcccccgttacggtacctcccg

SEQ ID NO: 307617 - DNA, 519 bp, Homo sapiens
  misc_feature: GZ8MTXP02FYWF3.39.13.B02.1.454.CMB.2.raw
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctcttgtaccacatccaccaggacaaacgtccccaaactgatgtatttangagtcaactaaacgcctcgtagggttctaatcgcttctctcgctcatctgcacncgcctccnacntctcgtggcctcgagntgaggcgagctctctattatcgctagtcactaatactaacatctattatctagttggtgtcggcggacggactccgtacgtaccgttactaggtccaacggccctaacggccgtccgaccccgtcggtacttacccg

SEQ ID NO: 307618 - DNA, 603 bp, Homo sapiens
  misc_feature: GZ8MTXP02J0ZE1.39.13.B02.1.454.CMB.2.raw
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccngcagtgacgttggtgttatactatgtctctagtaccaacactcaccaggacaaacgtccccaaatgatgtattangagtacactaaacggcctacgtagggtttctaagtcgtacttcctctgtctacctaagtcctggccaaacgaccggtccctccgtacgacctatcctacgtcgggcctccgaggctaggacggacggacggtctctacgtatttagttcgacacgtctactataacttaacgaactcttaaagttactacgttacgttggggtcgtttacgggacgggtaacggtaccgtaaccgtcgtaacccgttcgttaacggccaacggaccccgtaaggtccgtacccggccccttacgggtcctacccg

SEQ ID NO: 307619 - DNA, 532 bp, Homo sapiens
  misc_feature: GZ8MTXP02JRIIW.39.13.B02.1.454.CMB.2.raw
  modified_base (321)..(321): a, c, t, g, unknown or other
  misc_feature (321)..(321): n is a, c, g, or t
  modified_base (374)..(374): a, c, t, g, unknown or other
  misc_feature (374)..(374): n is a, c, g, or t
  modified_base (454)..(454): a, c, t, g, unknown or other
  misc_feature (454)..(454): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtcccccaaaatgatgatttatgaggtcactaaacggccctnaggggtttctaatcgcttcctctggctccaagtctggctaacacggcctcccngacccattctctgggctcctaggcctgagcgaggctctctattattgcagctcatatacaagcattatctacttggggtntttcgggcggtaggggacccgacgtacggtaccgtcgttacggtcaaggcccaagggcctcgccccctcggtctaccg

SEQ ID NO: 307620 - DNA, 526 bp, Homo sapiens
  misc_feature: GZ8MTXP02FJY1F.39.13.B02.1.454.CMB.2.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
  modified_base (433)..(433): a, c, t, g, unknown or other
  misc_feature (433)..(433): n is a, c, g, or t
tcagtcgcactagtcacgaccggtgctcgatttagtctagcgacttgcgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcaccatctcctgcactggaaccngcagtgacgttggtggttataactatgtctcttggtaccaacatcacccaggcaaagtccccaaatgatgatttangaggtcactaaacggccctcaggggtttctaatcgcttctctggctccaagtctggcaacacggcctccctgaccatctctggctcaggctgagacgaggctactctattattgcagctacatatacaagcattanctacgttgggtcgttcggacggtacgggaccgtaccgtacggaccgttacgtacggtccacggcccaaacggcctccggccccctcggtaccc

SEQ ID NO: 307621 - DNA, 606 bp, Homo sapiens
  misc_feature: GZ8MTXP02GBH7A.39.13.B02.1.454.CMB.2.raw
  modified_base (196)..(196): a, c, t, g, unknown or other
  misc_feature (196)..(196): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcacatctcctgcactggaaccagcagtgtacgttggtagttataactatgtctcttggaccaacatacacccagacaaacgtaccccaaactgatgtatttagtgagtcaacgtaaaccgcctacgtagggtttactaatcgtcttcctcgtcgtctacctaagtctggcaaccgccggtccctcctacgacctatctcgtgcctcgagcgtagacggacgagcttctacttattagttcgactacgtactcctaataacttaaccgaagtaccttaatttatacgttaacgtttggggttcgtttacggggaccgggtacgggtacccgtaccgtacggtacccgttacgttacggtaccaacggtacccgaacggtccgtcgcccgttccgtcggttacccg

SEQ ID NO: 307622 - DNA, 553 bp, Homo sapiens
  misc_feature: GZ8MTXP02GEH6C.39.13.B02.1.454.CMB.2.raw
  modified_base (419)..(419): a, c, t, g, unknown or other
  misc_feature (419)..(419): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctcttgtaccaacatcacccaggcaaacgtaccccaaactgatgatttatgagtcaactaaacggccctacgtagggtttctaatcgtcttcctctgctcaagtctggcaacacggcctccctgaccatcctcgtggcctccgaggctgagacgagctctcgtattatnctagctacatataacaagtctattactctacgtttgggtcgttacgggacgggtagggtacccgtacgtcggtacccgttacgttacggtacaacggtacccgaaggcctaccgcccccgtacggtcctacccg

SEQ ID NO: 307623 - DNA, 664 bp, Homo sapiens
  misc_feature: GZ8MTXP02GDFFC.39.13.B02.1.454.CMB.2.raw
  modified_base (310)..(310): a, c, t, g, unknown or other
  misc_feature (310)..(310): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatccaccatcctcctgcacgtggaaccagcagtgacggttggtagttaataactatgtctcttgtaccaacatccaccaggacaaacgtaccccaaatgatgtatttanaggagtacaaacgtaaaccggcccttaggtacgggtttacaacgtcgtcttaccctcgtcgtctacgaagttcctcggaccaaaccgacccggtcccttaccccgtacgaaaccctacttcccgtccgtcggggtccctacccggtacggtcgtacgggaacgggtaccggaggtccttactacgttatttacgttcgactacgtctataactaactaacaaagtctaaacttactacgtacggtttgggtcggttacggggacgggtaccggacccgtaccgttacggtacccgttacgttacggacgaaccgacccgtaacggcccttcccgtccccgtacggtcctacccg

SEQ ID NO: 307624 - DNA, 642 bp, Homo sapiens
  misc_feature: GZ8MTXP02IEP48.39.13.B02.1.454.CMB.2.raw
  modified_base (306)..(306): a, c, t, g, unknown or other
  misc_feature (306)..(306): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaaccagcagtgtacggtttggtagttaataactatgtctctggtaaccaacatccaccaggacaaacgtccccaaatgatgattangagtcaactaaacgcctagtagggtttacaatcgtcttaccctcgtcggctaccgtaaagtccgtagggaccaaacgaccggtcccctacccgtacgacctattccgccgttcgggaccttccgaaggtcgtaggacgggaaccgtacgggtcctccttacttaatttagttcggactacgtacctataactaacttaacaaacgtactaatttactacgtacgttggggtacggtttcgggacgggtacggaccgtaccgtacgtaacccgttcgtaacggtccgaacggtacccgaaacggtcccgtccggacccccgttacggtcctaacccg

SEQ ID NO: 307625 - DNA, 665 bp, Homo sapiens
  misc_feature: GZ8MTXP02G166Z.39.13.B02.1.454.CMB.2.raw
  modified_base (222)..(222): a, c, t, g, unknown or other
  misc_feature (222)..(222): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcgtggacagtcgatcacatctctgcactggaaccngcagtgtacggttggtagttataactatgtctcttgaccaacatccaccaggacaaacgtacccccaaactgacttagtatttagtagaggtaccaacgtaaacccggtcccgtacggttacggggtttacctaacgtcgtcctttaccgtcgtcggtacctaccgaagttccgtaggacccaaaccgccggtccccttaccctacgaaccctacttccgttcgttcgggcccttacgacgggtcgttagggacgggtaaccggcggtccttaccttacttaatttagtcgtactacggtacttactaatactaacgaaacgtcttaattacgttaccgttaggtttcggggtcggtttacggggcgggtaacgggaccgtacgtacggtacgtactttagggacaacgtaccgacggtcctccggccccttacggcttcccg

SEQ ID NO: 307626 - DNA, 588 bp, Homo sapiens
  misc_feature: GZ8MTXP02HHHSA.39.13.B02.1.454.CMB.2.raw
  modified_base (209)..(209): a, c, t, g, unknown or other
  misc_feature (209)..(209): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (491)..(491): a, c, t, g, unknown or other
  misc_feature (491)..(491): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctggggggaggcttggtacagcggggggggtccctgagactctcctgtacagtctctggattcagctttagcacctatgccatgagctgggtccnccaggctccgaggggaaggggctggagtgggtctcatccattagtggtgccagtggtggtaatacatattangtggactccgngaaggccgttcacntctcagagacaattccaaagaacactctgtatctgaccaaatgaacagcctgacgcgccgaaggaccaccggccctagtacttactgtgactaaactctcccgtagttgtacggtttcgccctaacctaactttcgaccgttccgtcggggccgtacgggacccgtggtcctaccgtcctcctcncgcctaccaccgaacggcccacgtccggtcccttcccccgtcggccctaccctccctaccaacgacgacctaccgtcggtcggggaccaacgccggg

SEQ ID NO: 307627 - DNA, 549 bp, Homo sapiens
  misc_feature: GZ8MTXP02JL17W.39.13.B02.1.454.CMB.2.raw
  modified_base (402)..(402): a, c, t, g, unknown or other
  misc_feature (402)..(402): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctgtacacatcaccaggacaagtccccaaactgatgtatttatgaggtcaactaaaccggccctgtaggggtttctaatcgtcttcctctgctaccagtctggcaacacgtcctccctagaccatctctcggctccgaggctgagacgngactcgtactattattgcagtctcatatacagctattactctacgttgggtgttcggacgggtacggacccggaccgtacggtacccgttacgttacggtacgaacgacccgacggtaccgtccgtacccccgttcggtacctcccg

SEQ ID NO: 307628 - DNA, 679 bp, Homo sapiens
  misc_feature: GZ8MTXP02FOJI1.39.13.B02.1.454.CMB.2.raw
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccgagggaaggggctggagtgggtctcatccattagtggtgccgagtggtgtaatacatattatgtgactcgtgaggccgtcacntctcagagacaatccaagacactctgtatctgaccaaatgaaacngctgacgcgacgaggacaccgtcctaatacttactgtgacgtaaactcctacccgtacgttaggtacggttttacgaccctaaccgtaacctttcgtaccgttcccggtacgggggacccggtaaccggggtaaccccgttcgggtacccgtaccccggttcccttcccttaccgaccggtcccctacccgaacccggaaccgggtacccctaccggttcccggttccccgtttccccccgtccgggtaccccctaacccccttcccgttaaccccgaaacgtacccgacccgtacccggtaccgggtccgggggaccacccggtacccgggg

SEQ ID NO: 307629 - DNA, 677 bp, Homo sapiens
  misc_feature: GZ8MTXP02F6IYE.39.13.B02.1.454.CMB.2.raw
  modified_base (224)..(224): a, c, t, g, unknown or other
  misc_feature (224)..(224): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcacgtggaaccngcagtgacggttggtgttataactatgttctcttgtaccaacactcaccgaggacaaacgtaccccaaatgatgtatttatgagtaccaactaaaccgtccgtacgtaagggtttctaactcgtacttcctcgtcggctaccgagttcctacgggacctaaacccgaccggtcccttaccccgtccgtaaccctactccgttcgtccgggtcccttaccgaggccgttagggaaccggtacgggacgggtccttaccgtttattaactttacgtttcgaccgtacgtctttacaacttaaacttaacgaacctattaattaactcgttaacggtttggggttacgggtccggggtacgggaacgggtacccgtccggttacgtaccggttacgttacggtacgaacggacccgtaacggtcccgtacccggtccccgtcggtaccttacccgg

SEQ ID NO: 307630 - DNA, 520 bp, Homo sapiens
  misc_feature: GZ8MTXP02H4VM0.39.13.B02.1.454.CMB.2.raw
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcatcaccatctcctgcactggaaccagcagtgacgttggtgttataactatgtctcttggtaccaacatcacccaggcaaagtccccaaatgatgatttatgagtcactaaacggccctgagggtttctaatcgcttccnctgctcagtctggcacacggcctcccngaccatctctcggctcgagctgacggtacgaggctctctattattgcagtctcatatacganacattanctagttggtcgttcggcggaggaccgacgtcgtaccgtcgttacgtacgaacgtacccaagggtctccgcccccgttcggtacctaccg

SEQ ID NO: 307631 - DNA, 575 bp, Homo sapiens
  misc_feature: GZ8MTXP02JR3CC.39.13.B02.1.454.CMB.2.raw
  modified_base (225)..(225): a, c, t, g, unknown or other
  misc_feature (225)..(225): n is a, c, g, or t
  modified_base (314)..(314): a, c, t, g, unknown or other
  misc_feature (314)..(314): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttgggtgttataactatgtctcttacggtaccaacactccaacccaggaccaaacgtacccccaaattgattgtatttangaggtacacgtaaacgccctgtagggtttacaatcgtcttcctcgtcgtctacctaagtctagggccaaaccgccggtcccctaccctgacctacttcctcgtcggcctcgaggccgtaggacgaacggcggtctctctagttactgcagctacataanaacganactaattatacgtcgttgggtcgttcgggcgggacggtaccgacgtacgaccgttcgtagtccgaacgcccacgtcctccgcccgttcggactccg

SEQ ID NO: 307632 - DNA, 770 bp, Homo sapiens
  misc_feature: GZ8MTXP02HXOIV.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatcctcctgcactggaaccagcagtgacgttggtagttataactatgtctcttgtacaacatcaccaggacaaacgtccccaaactgatgtatttagtgagtacaacgtaaacgcctagtagggtttctaacgtcgtctttcctcgtcggctaccgaagttcgtacggacctaaaccgaacccggtccccttaccccgtacgaaccctacttcccgttccgttcggggtcccttcccgaacgggtccgttacggggaaacggggaaccggtaacgggtcccttaccgtttacgttaattttaacgtttcggacctaacggtccttaactaaacttaactaaaccgtaaacgtacttaaagtttaacttaccgttaacgttttacgggggttccggttaccgggggtaccggggtaaacccgggggttaaccccgtaaccccggtttaccggggtaaccccggtttaccgtttaaccggggttaccgtaaacccgggaacccccggtaaaggtccccccggttacccggttacccccccggtttccgggttaccctttaacccccgg

SEQ ID NO: 307633 - DNA, 663 bp, Homo sapiens
  misc_feature: GZ8MTXP02HLPMF.39.13.B02.1.454.CMB.2.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (638)..(638): a, c, t, g, unknown or other
  misc_feature (638)..(638): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttaatactntgtctnttgtaccaanactcaccaggacaaacgtccccaaatgaatgtatttagtgagtacaactaaacggtccctgtaaggggtttctatcgtcttccctcgtcgtacttccaagttccgtagggcctaaaccgtaccgggtccctaccccgtacgtaaccctaacttcccgtcgttcggggtacccttaccgaacgggtcgttacgggaacgggtaccggaacgggtcctacgttaccttaagtttaacgttcgaccgtaagtcctactaattaacgtacgaaagtactacttaacgtcgtaacgttggttcggttacgggacgggtacgggtaccgtaccgttacgtaccgttacgttacggacgtaaaccgcccgaaacggttcccnccggtcccccgtcggttaccctccg

SEQ ID NO: 307634 - DNA, 601 bp, Homo sapiens
  misc_feature: GZ8MTXP02GI9PZ.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtggttataactatgtctcttggtacaacatcaccaggcaaacgtccccaaatgatgatttatgagtcaactaaaccggccctcgtaggggtttctaatcgtcttcctctcggtctaccgaacgttcctagggcctaaacgaccggtcccttaccccgtcgaccctacgttcctccgtcggggtccttcccgaaggtcttaggacggaccgtaggccttctcttattagttgacagtctactaattacaactaagctaattactccttacgtttgggtacgttcgggacgggaggtacccgtacgtcgtaaccgttcgtacggtaccaacgtcccgtaagcctaccgcccccgtcggtcctacccg

SEQ ID NO: 307635 - DNA, 615 bp, Homo sapiens
  misc_feature: GZ8MTXP02F01K3.39.13.B02.1.454.CMB.2.raw
  modified_base (313)..(313): a, c, t, g, unknown or other
  misc_feature (313)..(313): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatcctcctgcactggaaccagcagtgacggttggggttatgactatgtctcgtggtaccagacaatactccgaggcaaccacgacccccaaatcatactatttagngaacggtacagtaacgtccggaccctggtaagggtttactaacgtccgtcttcgtcgtcggtccttacgacgttctagggacctaaacccgcccggtcccttcccgacgaaccctacgttcctcgtcgggcccttacggacgtcgtaggaacggccgaagtcgtagttaacttatactgactagtcttactnttacgcttaaagngtagtagtnttacgttagtacgttacgtaagggtacggtacggaacgtagtacgtaacgttccgtaacgtacgtaccgacgtaacccgaaccgaccc

SEQ ID NO: 307636 - DNA, 600 bp, Homo sapiens
  misc_feature: GZ8MTXP02GIMLE.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcttggtaccaacatccacccaggacaaacgtacccccaaatgattgtatttatagaggtcaacgtaaaccggccctacgtagggtttctaatcgtcttcctctgctccaagtctgcacacggcctcctcgaccatctcgtggctcgagctagaggacgaggtctctactattattcgactacgtctacaattaataaccaagtactatttaactcctaacggtttcggggtcggtttacgggacggggtaacggggtacccggtaccgttacggtacccgttacgttacggtaccaacggtacccgaaacggtccgtcccgtacccccgtcgggtacccttacccg

SEQ ID NO: 307637 - DNA, 532 bp, Homo sapiens
  misc_feature: GZ8MTXP02FU687.39.13.B02.1.454.CMB.2.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcttggtaccaacatcaccaggcaaagtccccaaatgatgattatgagtcactaaacgtccctcgtagggtttctaatcgcttctctgctcagtctgcacncgcctccnacatctgtggctcagctgacgacgagctagattatactgcagctctatttgactaatcagttgaggtacttagtcgttacgttacggaaggtcgggaaccgtaaggtccgtaagtccggtaccgttaaggcgaacgacccccgaacggaccccaaacccctacgttacccg

SEQ ID NO: 307638 - DNA, 724 bp, Homo sapiens
  misc_feature: GZ8MTXP02IFYVS.39.13.B02.1.454.CMB.2.raw
  modified_base (303)..(303): a, c, t, g, unknown or other
  misc_feature (303)..(303): n is a, c, g, or t
tcagtcgcactagtcacgaccggtgctcgatttagtctagcgactttgggctgagctgccttttttcttgtggctatgttaaaaaggtgtccagtgtgaggtgcagctgttggagtcgtggggggaggcttggtacgaggcggggggggtccctgagactctcctgtacagtctctggattcagtctttagccacctatgccatggagcgtcgggtcccgccgaggcctccggaagggggaaggggcgtggaggtgggtctcactcattaggtggcgcgaggtggtagtaatacattattagnggtaggacctcggtaggaacgggtcccggtttaccacctatcctaccgaagaacgaactaactaacccaaagaacctacttctagtactcagaaccctaaaatacgaacacgactacggacggccggaccgaaggacccgacccgtacccttatacttacgtagtacgaacgtaaactcccgtacccgtatttcggttacggtttacaaccctaaccgttaactttcgacccgttccggtacggggacccgttaaaccgggacccttcgggtaccctacccgttcctacccctcgaccgccctacccgaaccgaacccggtccctacgtttcccggtacccccttaccccggcgtaccccctaccccgttacctaacccgaacgtccgaccgtacccgtcggtccgggaccacggcccggg

SEQ ID NO: 307639 - DNA, 638 bp, Homo sapiens
  misc_feature: GZ8MTXP02I9WU4.39.13.B02.1.454.CMB.2.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactntgtntctgtaccaacaccacccggacaaacgccccgaagtcatnatttangacgtcaactactcgccctgagggtgtctaatcgtcttcctctggctaccagtctggctaacacggtccctcctacgaccatcctcgtcggcctccgacggcctaggacggacggacggcgttagtaatttaacttacgtcggtacacggtacctactaacgttactttaccgaaagtaccgtaaaggttaacttaccgttaccgttacccgttttaccgggggaccggggtaccgggaaaccgtaaccggtaccgacggttacccggtaccgtacggttaccgaaccggtacccgaaacgggtcccgtacccggtacccccgtacgggtacccttacccg

SEQ ID NO: 307640 - DNA, 547 bp, Homo sapiens
  misc_feature: GZ8MTXP02GQRVH.39.13.B02.1.454.CMB.2.raw
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
tcagtcgcactagtcacgaccggtgctcgatttagtctagcgacttccgcgggggggtctcaggaggcagcgctctcaggacatctccaccatggcctgggctctgctgcgtcctcaccctcctcactcaggcacagggtcctgggcccagtctgccctgactcagcctgcctccgtgtctgggtctcctggacagtcgatcaccatctcctgcactggaaccagcagtgacgttggtgttataactatgtctcttggtaccaacatcacccaggcaaagtccccaaatgatgatttangagtcactaaacgccctgagggtttctaatcgcttcctctggctaccgaagtctaggctaacacggtccctccngaccatctctggctcagctgaggacgagctcgtactattattgacagtctacatatacaaagctattactctacgttgggtgttcggacgggtacgggacccgtacgtacggaccgttacgttacgtcgaacggaccccaagggtcctccggtacccccctcggtacctacccg

SEQ ID NO: 307641 - DNA, 567 bp, Homo sapiens
  misc_feature: GZ8MTXP02G4XKG.39.13.B02.1.454.CMB.2.raw
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctcctgcactggaaccagcagtgacgttggtgttataactatgtctcttggtaccaanatcacccaggcaaagtccccaaatgatgattangagtcactaaacgcctgtagggttctaagtcgtcttcctctgctaccagtctcgcaacacggcctcctgaccatctctggctcgaggctgagacgaggctcgtctattattcgacagtctactatactaacaagtactaattacgtacttaacgttggggttacgttcgggacgggtacgggacccgtaccgtacggtacccgttacgttacggtaccaacggtaccccgtaaacggtcctaccggtccccccgtcggttaccttaccccgg

SEQ ID NO: 307642 - DNA, 574 bp, Homo sapiens
  misc_feature: GZ8MTXP02I9XLU.39.13.B02.1.454.CMB.2.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (263)..(263): a, c, t, g, unknown or other
  misc_feature (263)..(263): n is a, c, g, or t
  modified_base (377)..(377): a, c, t, g, unknown or other
  misc_feature (377)..(377): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacngtcatcaccntctcctgcactggaaccngcagtgacgttggtagttaataactatgtctctgtaccaanatcaccaggacaaacgtaccccaaatgatgtatttatgagtcaactaacggcctcgtagggtttctaatcgtctctctcgctacagtctcggcaacgccggtcctcctagaccntctcgtggcctcgaggctgagcgacgtctctcttaattcgttgctagtcctcaatttaacaactaagacttaattataccgttagttggggtcgtttccgggacggttaacggggacccgtacgtcggtaacccgttcgttaacgggtccaaccggtacccgtacgtcctacccggtccccgtcggtacctttcccg

SEQ ID NO: 307643 - DNA, 629 bp, Homo sapiens
  misc_feature: GZ8MTXP02H43T7.39.13.B02.1.454.CMB.2.raw
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggccccagtctgccctgactcagcctgcctccgtgtctgggtctcctggacagtcgatcacatctctgcactggaaccngcagtgtacgttggtagttataactatgtctntcgacaacactcaaccaggacaaacgtccccaaatgatgtattagtgaggtacaactaaacggccttacgtagggtttactaagtcgtcttcctcgcgtctaccgtaagtctacggccaacctacggtcccctccctacgtacccagttccgtcgtcggccttccgagcgtggaggaccgaggctcttactattatagctacgtctactaataactaactaaacgacttaattacttcgttacggtttggggttcggttccggggtacggggtaccggggtaacccgtccggtaacggttaccggtaccgtttacggtacgtaaccgtacccggaacggtcccgtacccgtcccccgttacggtccctacccgg

SEQ ID NO: 307644 - DNA, 570 bp, Homo sapiens
  misc_feature: GZ8MTXP02GYT21.39.13.B02.1.454.CMB.2.raw
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcacatctcctgcactggaaccngcagtgacggttggtagttataactatgtctcttgaaccanatcaccaggacaaacgccccaaangatgtattagtgaggtacaactaaaccggcctacgtagggtttactaatcgtcttctctgctcagtctgcacacgccctccngaacctntctcgtcggctccgagtcgtgacggacgaggtcctctacgttattagttgactagtctactaattaataacaagtactaattactacgtacggttggggtcgttacggggtcgggaacgggacctaaccgtcgtaaccgtcgttacggccaacgacccgaacgtccgtcccgtccccgtacgtacctaccg

SEQ ID NO: 307645 - DNA, 574 bp, Homo sapiens
  misc_feature: GZ8MTXP02H21QG.39.13.B02.1.454.CMB.2.raw
  modified_base (220)..(220): a, c, t, g, unknown or other
  misc_feature (220)..(220): n is a, c, g, or t
  modified_base (256)..(256): a, c, t, g, unknown or other
  misc_feature (256)..(256): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcaggcacagggtcctgggcccagtctgccctgactcagcctgcctccgtgtctggtctcctggacagtcatcaccatctctgcactggaaccngcagtgtacgttgtgttatactatcgtcctgaccanatcacccagacaaacgtcccaaatgatgtattatgaagtcaactaaacggcctagtagggtttcaaatccgtnttctcctggactcaagttcnggaccactaccggcctaccctgacctacgtctcgtcgcctcgacggtctaggaccggagacggtctactcgttaatttacgtagctactactataataactaacaagtataatactacgttacggttcggtacggtacggtacgggacggtaccggtaccgtacgtaccgttacgtacgtacgacgaaccgacgaccgtcccgtcccgtccgtaccgtacctccg

SEQ ID NO: 307646 - DNA, 615 bp, Homo sapiens
  misc_feature: GZ8MTXP02FN733.39.13.B02.1.454.CMB.2.raw
  modified_base (318)..(318): a, c, t, g, unknown or other
  misc_feature (318)..(318): n is a, c, g, or t
tcagtcgcactagtcacgaccggtgctcgatttagtctagcgactttgggctgagctgcctttttcttgtggctatgttaaaaggtgtccagtgtgaggtgcagctgttggagtctgggggaggcttggtacaggcggggggggtccctgagactctcctgtacagtctctggattcagcttttagcacctatgccatgagctgggtccgccaggctccgaggggaaggggctggagtgggtctcatccattagtggtgccagtggtgtaatacatattatgtggactccgtagaagggccgttcaccatctccaganacaattccaaagacactctgtatctgaccaaaatgaaacagcctagacgcgccgaggaccacggccctatattactgtagacgaaatcctacccgaatttggacggtttcgaccctaacctaacgtttgaacctccgttacgggggcccaacggggaaccccttgggtaccaccccggttctcccgtcacgccctaccaccgtaacgggcccacgttccggtacccttccccgtcgaccctaccccgtccaaccgaacgaccgtaccaccgtcgggacggggacccacggacccggg

SEQ ID NO: 307647 - DNA, 648 bp, Homo sapiens
  misc_feature: GZ8MTXP02G6F57.39.13.B02.1.454.CMB.2.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (508)..(508): a, c, t, g, unknown or other
  misc_feature (508)..(508): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctctgcactggaaccngcagtgacgttggtgttataactatgtctcttgtaccaanatccaccaggacaaacgtaccccaaatgatgtattagngagtacaacgtaaaccggccctagtacgggtttactaagtccgtcttcctcgtcggtactaccgtaagtcgttcggaccgtaaccgaacccggtcccttacccgtcgaaccctactccgtcgtcgggcccttccgaagggtccgtagggacggaccggtaacggtccttaccttacgttatttagttcgaactcgtactctaagttanaacgaactactatactcgttacgttggggttcgttacgggacgggtacgggacccgtacggtacggtacccgttacgtacggttacccgaacgtcccggaacggtccggttacccgtcccccgttacggtaccttccccg

SEQ ID NO: 307648 - DNA, 701 bp, Homo sapiens
  misc_feature: GZ8MTXP02HATSI.39.13.B02.1.454.CMB.2.raw
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacctatctcctgcacgtggaaccagcagtgacgttggtgttaanactntgtctnttgtaccacatcacccaggacaaacgtccccaaatgatgtattanagagtacaacgtaaacgccttagtacgggtttactaatcgtcttcccgtcgtggacctccgaagttccgagggccaaacgcccgggtccctcccgtacgtaccctatcctcgtgggcccttaccgaggtccgtaggacggacgtacgggtaccttcgttaccttatttaacgttcggtaccaacggtccttaacgtaattaaacccttaaagaacgttaacttaacgttaacgttaacgttacggtttacgggttacgggttaccggggtacggggtaccggggtacccggtaccggttaccggttaccggttaaccggttaaccggtaccggtaaccggtaacccggtaaccggtacccggtaccccggtacccccggttacccggttacccgtacccg

SEQ ID NO: 307649 - DNA, 688 bp, Homo sapiens
  misc_feature: GZ8MTXP02F9D7J.39.13.B02.1.454.CMB.2.raw
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacggttggtgttaataactatgtctcttggtaccaacatccaccaggacaaacgtaccccaaatnatgtaattangtagtacaacgtaaaccggcctagtagggtttctaatcgtacttcctcgtcggtactaccgtaaagtccgttacgggccaaaaccgtcccggggtcccttaccccgtacgaaccctacgttcccgttacggtcggggtacccttcccggaagggtccgttaagggaacgggacccggtaagggtcctttactaccttaatttacgttcgacctaacgtcctactaaacgttaactaaacaaacgtctaaatttactaccgtagtttggggtcgttaccggggacgggtaacgggacccgtacggtcggtaccgtttacgttacggtacgaaccggtacccgtaacggcccctttcccggaccccctacggtacccttacccg

SEQ ID NO: 307650 - DNA, 562 bp, Homo sapiens
  misc_feature: GZ8MTXP02HVGIA.39.13.B02.1.454.CMB.2.raw
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcaggcacaggtcctgggcccagtctgccctgactcagcctgcctcgtgtctgggtctcctggacagtcgatcaccatctcctgcactggaaccagcagtgacgttggtgttataactatgtctctggtaccaacatccacccaggcaaacgtacccccaaatgatgatttangagtcactaaacgcctgtagggtttntaatcgtcttcctctgctcagtctggcaacnccgcctccctgaccatctcgtcggcctcgagctggaggacgngtactcttctaatttnttcgacngtcctntaatactacaatcctaattagtactacgttgggttcgttcggggacgggtacggtacccgtaccgtcggtaccgttaccgtttagcgaaccgtcccgaacggtcctcccggtccccgttcggtaccttaaccccg

SEQ ID NO: 307651 - DNA, 554 bp, Homo sapiens
  misc_feature: GZ8MTXP02IYRCO.39.13.B02.1.454.CMB.2.raw
  modified_base (224)..(224): a, c, t, g, unknown or other
  misc_feature (224)..(224): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttatactatgtctctgtacaacntcacccagcaaacgtccccaaatgatgatttangaggtacactaaacggccctacgtagggttctaatcgcttccactgctaccaagtctaggcaacacggccctcctcgaccatctcgtggcctcgaggtctgagacgagtctactntattagtcgcagtctactatactacaanctatttaacnctaacgtttcgggtacgttcgggacgggtacggacccgtcgtacggtacccgttagttaacggccaacgacccgtaacgcctaccggccccgttaggtccctaccg

SEQ ID NO: 307652 - DNA, 671 bp, Homo sapiens
  misc_feature: GZ8MTXP02JI3Q4.39.13.B02.1.454.CMB.2.raw
  modified_base (208)..(208): a, c, t, g, unknown or other
  misc_feature (208)..(208): n is a, c, g, or t
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccntctcctgcactggaaccagcagtgacgttggtagttataactatgtctcttagtaccaanatccacccaggaccaaacgtccccaaactgatgtatttangaggtacaccgtaaacgcctagtagggtttctaactcgtcttcctcgtgtctacctagtcctagccgaacgacccggccctacccgtacgtaccattccctcgttccgggccttaccgacggtacgtgaacgggaccggacgggtcttcttacttaatttagttcgtacgtaacgtccttataacgttaactaaaccgtaagtacctaagtttactacccggttaggtttacggggttcggttaccgggggaccgggggttaacgggacccgttaaacccggttcgggtaacccgttcgtttaacggacccaacggtacccgacggtacccgttcccggcccccgttacggtaccttaccccg

SEQ ID NO: 307653 - DNA, 654 bp, Homo sapiens
  misc_feature: GZ8MTXP02H3QVN.39.13.B02.1.454.CMB.2.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
tcagtcgcactagtcacgaccggtgctcgatttagtctagcgacttccgcggggggtctcaggaggcagcgctctcaggacatctccaccatggcctgggctctgctgctcctcaccctcctcactcagggcacgagggtcctgggcccagtctggcctgacacagcctgcctcgtgtctgagactcctggacagtcatcaccatcncctgcactgaaccngcagtgacgttgncttataattngtctctgtccaanagcatcaggcacgaccgaccccgaaaacttctttaaaagtttactggtaacgtttccgttttccggtccggtcccctacggttacggggtttctagtccccgtcctttccgtcccgggcttacccgaaagttccgtcggaccaaaccgcccggtccctaccccgtagacctacgtcctaccgtaacgaccctccgaaggtcctaggaacggacgaaggctagaacttagttatgactagtactcaattagtaaccgttagaaaccgtataaacgttgtaacgtaccctaggttcggtactcgggtttaccgggaacggggaacggtaaccgtaaaggtttcgaacccgttccgtaaacgggtcccaaccggtacccgaaaggtcccgttacccccgg

SEQ ID NO: 307654 - DNA, 697 bp, Homo sapiens
  misc_feature: GZ8MTXP02FKTIS.39.13.B02.1.454.CMB.2.raw
  modified_base (268)..(268): a, c, t, g, unknown or other
  misc_feature (268)..(268): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcacgtggaaccagcagtgtacgttggtagttataactatgtctcttgaaccanactaccaccaggacaaacgtaccccaaatgatagtatttagtaggtagtacaacgtaaaccggtcctacggtacgggtttactaagtccgttcttcccgtacgtcggtacctaccgtaacgttccgtacggaccaaaccgacccgggtcccctaccccgtacgtacctacttccgttaccgtcggggtcccttaccgaacgggtcgtacggggaacggaccggtacggtccttacgttacttatttacgtcgactactctactaataacgtaaacgtaacgtacttaatttacgtacgttacgggtttcggggttacggttacggggacggggtaaccgggtacccgtaacgttcggtacccgtttacgtacggtaccgaacggtacccgaacggttcccacccggtaccccgtcggtacccttacccg

SEQ ID NO: 307655 - DNA, 719 bp, Homo sapiens
  misc_feature: GZ8MTXP02F29R2.39.13.B02.1.454.CMB.2.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccntcncctgcacgtggaaccngcagtgacgttggtagttaataactatgtctcttggtaccaacatccaccaggcaaacgtccccaaactgatgtatttangaggtcaactaaacggccctgtacgggtttctatcgtcttcctctgctcctaagtcttgggctaacgaccggtccctccccgtagaacctntccgttcgtcgggtccctaccgaaggccttagggaacggacggtaacgggtccttacgttaccttaagtttacgtttcgaccggtacgtaccctttaactaaacgttaaactaaccgtaaagttaccttaaacgttttaacgtaccgttaacgggttttgggggttaccgggttaccgggggtaaccggggtaaccggggttaaccccgtaacccggttaccggttaaccccggtttaaccggttaaccgggtacccgtaaccggtaccccggtaacggtcccccgttaccccggtacccccggttcggttaccccgtacccg

SEQ ID NO: 307656 - DNA, 595 bp, Homo sapiens
  misc_feature: GZ8MTXP02GRLW8.39.13.B02.1.454.CMB.2.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (429)..(429): a, c, t, g, unknown or other
  misc_feature (429)..(429): n is a, c, g, or t
  modified_base (494)..(494): a, c, t, g, unknown or other
  misc_feature (494)..(494): n is a, c, g, or t
  modified_base (555)..(555): a, c, t, g, unknown or other
  misc_feature (555)..(555): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcgatcaccatcctcngcacgtaggaaccngacngtgtacgttggtgttaatactatgtctcgttgtaaccanatcccaaccgaggacaaacgtccccaaatgactggtatttagngaagtacaacgtaaaaccgtccttacggtagggtttacagtcgtaccttctacgtcgtactacctaagtcggtacgacaaactccggccctacctcgaactagttcctcgacgggtccnccgaggtcaggacggaacgcggtctactacgttatttagtcacgtatcctagatttacaccgtanccttataaccgtctggtggttacgtacggcggaaacgccgtactaacggtcttaaccggtntacgaaccgaccgtaggtcctccggacccttgtacctccc

SEQ ID NO: 307657 - DNA, 509 bp, Homo sapiens
  misc_feature: GZ8MTXP02FG5TB.39.13.B02.1.454.CMB.2.raw
  modified_base (223)..(223): a, c, t, g, unknown or other
  misc_feature (223)..(223): n is a, c, g, or t
  modified_base (343)..(343): a, c, t, g, unknown or other
  misc_feature (343)..(343): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttataattatgtctctggtccaacagcattcaggcagccgaccccgaaactcttaattatgtaggtctttcgcggtccctcgaggggtttctagtccgtcttcnccggctcaagtctggcaacacggccctcctgacctatcctctacgacctccaggctgaggacgaggctagactattatgcagctcatatactgaactcaatgtactccactgctggtcggcggacggaccaagttcgaaccgtcgaggtcacgccgaacgctcccg

SEQ ID NO: 307658 - DNA, 591 bp, Homo sapiens
  misc_feature: GZ8MTXP02GP28W.39.13.B02.1.454.CMB.2.raw
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttaataactatgtctcttggtaccaacatcacccaggacaaacgtccccaaatgacttgatttatgaggtcaactaaaacggccctacgtaggggtttactaagtcgtactttcctctggtcctccgaaagttccgtaggctaacgaccggtccctacccgtgacctactctcgtgggcctcgacggctagacggacgtaggtctctacgttaattagtcgactagctacaatactaacaagctattactactagttggtcgttacgggacggtacggggaccctacgtcgacccgttcgtacgtacaacgtacccgtaacggtcctacgtcccccgtcggtaccttaccg

SEQ ID NO: 307659 - DNA, 669 bp, Homo sapiens
  misc_feature: GZ8MTXP02JW9TQ.39.13.B02.1.454.CMB.2.raw
  modified_base (498)..(498): a, c, t, g, unknown or other
  misc_feature (498)..(498): n is a, c, g, or t
tcagtcgcactagtcacgaccggtgctcgatttagtctagcgacttccgcgggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtagttataactatgtctcttggtaccaacactccacccaaggaccaaacgtccccaaagtgaatcgtaatttagaggacggtacaacgtaaaacccgggtccctacggtaggggtttactaacgtcgtacgtttccctacgtggacctaccgaaacggttctacgggccaaaccgtccggtccctacccgtagaccctagttcgccgtggacctcccgaaggtcacggaggaccgtagtactcgtactagttactggactntactactattaacgaacacgtactaagtttcgtaccgtacgtttcgggggtcgttaccgggacggggaaccggtaccgtaacgtcggtaaccccgttagttaacgggtaccaacgggtaaccccgtacggggtaccttcccgggtacccccttacgggaccctttaaccgg

SEQ ID NO: 307660 - DNA, 581 bp, Homo sapiens
  misc_feature: GZ8MTXP02IPTU2.39.13.B02.1.454.CMB.2.raw
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagtctgcctccgtgtctgggtctcctggacagtcgatcaccatcctcctgcactggaaccagcagtgacgttggtgttataactatgtctcttggtaccaacatcacccaggacaaacgtccccaaatgatgtatttatagagtacaactaaaccggcctacgtagggtttctaagtcgtcttcctcgtgcctacagtctgccacaccggccctccctacgacctatcgtcgtcggcctcgacggctggaggacgaggtcttcgtattagtttatcgtcacgtctactataactacaagactaattactcgttaggttgggtaggttccgggacgggtacgggaccgtaccgtacggtaccgttcgtacggtacgaacgacccgtacgtccgtaccgtcccccgtcgtacctaccg

SEQ ID NO: 307661 - DNA, 654 bp, Homo sapiens
  misc_feature: GZ8MTXP02IZU88.39.13.B02.1.454.CMB.2.raw
  modified_base (297)..(297): a, c, t, g, unknown or other
  misc_feature (297)..(297): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcacatctctgcactggaaccagcagtgtacgttggtgttataactatgtctcttggtacacatcaccaggacaaacgtccccaaatgatagatttangagtcaactaaccggcctcgtaggggtttctaatcgtcttcctcgtgtctaccaagtccgtggcaacgaccgggtccctcccgttacgaccacttctccgtcggcctacccgaggcctgggaacgaccggaggtccttctccgttaagtttattacgggactaacgtccttactaacggttaaacctaaccaaagtcccttaaagttttaaaccgtccttaaacgggtttggggttacggtttccgggggtaacgggtaccggggtaccccgtaccggttacggtacccgtttacgttacggttaccgaacgtacccggaaacgtccgtacccgcccccgttcggtaccctttcccg

SEQ ID NO: 307662 - DNA, 768 bp, Homo sapiens
  misc_feature: GZ8MTXP02JTWVZ.39.13.B02.1.454.CMB.2.raw
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
  modified_base (363)..(363): a, c, t, g, unknown or other
  misc_feature (363)..(363): n is a, c, g, or t
tcagtcgcactagtcacgaccggtgctcgatttagtctagcgactttgggctgagctgcctttttcttgtggctatgttaaaaggtgtccagtgtgaggtgcagctagttggagtctgggggagcttggtacagcgggggggtcctgagactctcctgtacagtctctggattcagctttagcacctatgccatgagctgggtccncaggctcgagggagggctggagtggtctcatccattagtggtnccaggtggtagtaatacgattattatggtggaccttccggtaggaacggggtcccgttacaccgtagtcctaccgaaggacgaactaacgttacccgaaaagtacctaccgttntagttaactccgtagaaccctaaaagtcgaaacctacggtcctaggaacggcccgaccgggaacgggaacccgaccgggtacccttaattaacgtttacgtacgttacgaaaccgtaaacctcccgtttaaccccggtaagtttaggttacggtttcgacccgtaaccttaaacgtttcgaaaccgttccggttacgggggacccgtaacgggtaacccccgttgggtaccctacccggtccttacccgtaccgtaacgtccccttacccgaaacggaacccgggtccctacggtttcccggtccccgttccccgtacgggtacccctaaaccccttccggtaaacccaacggacccgacccgttacggttacccgggtacgggggacccaacggttacccgggg

SEQ ID NO: 307663 - DNA, 546 bp, Homo sapiens
  misc_feature: GZ8MTXP02FF58G.39.13.B02.1.454.CMB.2.raw
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtttggngttataactatgctctgtaccaacatcaccagcaaacgtcccaaactgatgtatttangaggtcaactaaacggcctgtagggtttcaatccgtcttcctctcgctacaagtctggcaaacgcgacctcccgtanaccactctcgcggtcctccgagctagaggacgngtactcgtactaattattgcacnctanataatacaaagtctaattactacttacgtggggttcgttcggacggggacggacccgacgtgtaacccgttctaacggtcaacgcccgaaggcctcgccctccgtcgtacc

SEQ ID NO: 307664 - DNA, 584 bp, Homo sapiens
  misc_feature: GZ8MTXP02JT0E5.39.13.B02.1.454.CMB.2.raw
  modified_base (262)..(262): a, c, t, g, unknown or other
  misc_feature (262)..(262): n is a, c, g, or t
  modified_base (407)..(407): a, c, t, g, unknown or other
  misc_feature (407)..(407): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgtacgttggtgttatactatgtctctgtacanatcaccagcaacgtcccaatgatgtattatgagtcacgtaacggcctgtagggtttctaatcgtcttccctcgtggtcctaccgaacgtctacggcaaccgaacggccccttcccttacgaccacttcctcgtcgggccttccgnggctgggacggtcggagtcgtcttacttattagttcgtcacgtctactataacttacaagtctaattactacgtacgtttggtcggttcgggacggacgggtaccgtaacgtcggtaccgttcgttacggtaccgaacgacccggaacgtccgtccggtccccctacggtctcccgg

SEQ ID NO: 307665 - DNA, 593 bp, Homo sapiens
  misc_feature: GZ8MTXP02I6O55.39.13.B02.1.454.CMB.2.raw
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (328)..(328): a, c, t, g, unknown or other
  misc_feature (328)..(328): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacatctctgcatggaaccngctagttcgtggtgttatactatgtctctgtacantcaccagcaaagtccccaaactgactgtatttatgagtcacgtaaacggccctagagggtttctaatcgcttcnctgctactagtctcggacacgtcggaccctcctacgacctacgtcgttcgtcgggccttacccgaaggccgtaggacggaacgcggtccttctaactatttacgtgtcctagtctactaatatacggaaactctattacgtactaggttgggtcgttacggggacgggtaacggtacctaccggttacggtaccgttacgttaacgtacgaccgtaacccgtacggtcccgtacccgtccccgttacggtacctaccgtttcccg

SEQ ID NO: 307666 - DNA, 677 bp, Homo sapiens
  misc_feature: GZ8MTXP02G616H.39.13.B02.1.454.CMB.2.raw
  modified_base (222)..(222): a, c, t, g, unknown or other
  misc_feature (222)..(222): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccatctcctgcactggaaccngcagtgacggttggtagttaataactatgtcttacgttcggtaaccaacactccaccctaacgggacaaacgtcccccaaaatcgaatggtaatttagtggagtacaaccgtaaaaccggcccttacgtacgggttacttaagtccgtacttcctctcggtactacctaacgtctggaccaacgaccggccctcccgtcaaccctatccgtcgttcggacccgttcccgaaggtcgttagggaacgggtaccggaacgggtcttactacgttatttaacttcggtacacgtactacgtattaaactaacgaaactacctaagtttacgtcgttaacggtttcggggtcgtttaaccggggcggggtaaccggtacccggtacgttacggtaccgttacgttacgaccgtaaccgaccgtaacggtcctccggtacccccgtccggtactttcccg

SEQ ID NO: 307667 - DNA, 694 bp, Homo sapiens
  misc_feature: GZ8MTXP02G58UD.39.13.B02.1.454.CMB.2.raw
  modified_base (270)..(270): a, c, t, g, unknown or other
  misc_feature (270)..(270): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgacttccgcggggggggtctcaggaggcagtgctctcaggacatctccaccatggcctgggctctgctgctcctcaccctcctcactcagggcacagggtcctgggcccagtctcgccctgactcagcctgcctccgtgtctggtcctcgtggacagtcgatccacctatctcctgcacgtaggaaccagctagtgtacgttggtagttatactatgtctctgtaccanatccaccagacaaacgtaccccaatgatntattatagagtacaacgtaaccgtcctagtacggttactacgtctcttccgtcgtcgtactaccgtaagttccgtacggaccaaccgtacccggtccccttacccgtaccggtaaccctacgttcccgttacccgtcggggtcccctaccggtacggtccgtacggggtaacggaccgggtacgttccttacgttaccgttaaagtttacgttcgtaccgtactcctaacttaataacctaacgtaacgtacttaacgttacgtaccgttacgggtttacgggttcggttaccggggaccgggtaccggtacccgtaccgttcggttaccgttacggtacgtaccgaaccggtccgaacggtccctaccccggtcccgttccggtaccttccccg

SEQ ID NO: 307668 - DNA, 729 bp, Homo sapiens
  misc_feature: GZ8MTXP02HGOGU.39.13.B02.1.454.CMB.2.raw
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcaggtgacgttggtgttataactatgtctctgtaccaacatcaccaggacaaacgtccccaaatgatgtattangaggtacaacgtaaaccggcctacgtagggtttactaagtcgtcttcctcgtcgctaccaagtctggccaaccgaccggtcccctcccgtacgtaacccacttccgtaccgtcgggtccctaccgaggtccgtagggacggggaccggtacgggtccttaccttaccttaagtttacgttcggtacctacggttacctactaacgttaaacttaaccgtaggtaaacgttactaaaaggtttcggttaaaccttcccgtaacggtttacgggtaccgtttccgggggttaccggggaaccgggggtaaccggggttaaacccgttaacgggtttacccggtaaacccccgggttccgttaaacggggttaccccgaaccgggtaaccccggtaaacgggtcccccgtttaacccccgggtacccccccgg

SEQ ID NO: 307669 - DNA, 799 bp, Homo sapiens
  misc_feature: GZ8MTXP02ISPJR.39.13.B02.1.454.CMB.2.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (450)..(450): a, c, t, g, unknown or other
  misc_feature (450)..(450): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctcgtggacagtcatcaccatctctgcacgtgaaccngcagtgtacggttggtagttatatntntctctagacanctaccaccagacaacgtacccaatgtatgtattanagtacgtacaaccgtaaccgccgttagtagggttactagtccgtactttccgtcgtcgtacctacgtaacgtccgttacggaccctaaaccgtcccggtccccctacccgtacgtaccctacgttcccgtccgggtacggtcccgtaaccgnggggtcgttaacgggacgggtaccggtacggttacccttcgtttaaccgtttaagtttacggtaccgtaaccggtacgttactaaaccggttaaacttaaaactaaaccgaacgttacctttaaagtttaacggtttacccggttacggggttttacgggggttacccggtttacccggggggaacccgggggtaaacccggggttaccccgtaaccgggttaacccggtttaaccccgggtttaccgggtttaaccggtacccccggaaaccggttacccccgggtaaacggttcccccggtacccccggttaaccccccggtttcggtaaacccccttttcccccgg

SEQ ID NO: 307670 - DNA, 661 bp, Homo sapiens
  misc_feature: GZ8MTXP02HDPF2.39.13.B02.1.454.CMB.2.raw
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcagcctgcctccgtgtctgggtcctctggacagtcatcacctatctcctgcatggaaccagcagtgtacgttggtagttaatactatgtctnttgaccaacatccaccaggacaaacgtaccccaaatgactgtatttagngacgtacaacgtaacccggcccttacgtacgggtttactaacgtcgtactttccgtctcggcctaccgaagtccgtacggactaacccaccgggtccccttacccgtacgtaccctaagttcccttccggtacggtcccttacgacggtccgtaaggggacgggtaaccggaggtcccttacgtacgttaactttacgtcgtacgtacgttactactaaacttaacgaaccaagtacttaacttacttacgttacggtttcggggtcggttaccggggacggtaccgggacccgtacgtacgtaccggttacgtacgtacgaacgaccgtacgtcctaccgccccgtcgtactaccg

SEQ ID NO: 307671 - DNA, 591 bp, Homo sapiens
  misc_feature: GZ8MTXP02IZ31G.39.13.B02.1.454.CMB.2.raw
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtggacggttggggttatgactatgtctcctgtaccagcaatatccagcacacgaccccaaactcatctattatgacgtcagtactcggcctgtagggtttctactcgcttctctcgctcagtcncggacaccaccgtccctcctgaacctntcctcgtcgggctccgaggcgtaggacggtcgagtcttcttacgtttattagttcgacgtcgactaccgtaattaactaacaagtacttaaacttctcgttaacggttgggttacggttacgggggacggaccgggtacccgaccgttacggtacccggttcgttacggtaccgaccggtacccgaacggtcccgtacccggttcccccg

SEQ ID NO: 307672 - DNA, 615 bp, Homo sapiens
  misc_feature: GZ8MTXP02GLYTY.39.13.B02.1.454.CMB.2.raw
  modified_base (299)..(299): a, c, t, g, unknown or other
  misc_feature (299)..(299): n is a, c, g, or t
  modified_base (422)..(422): a, c, t, g, unknown or other
  misc_feature (422)..(422): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctctgcactaggaaccagcagtgtacgttggtagttataactatgtctcgttgtaccaactactccaccaggacaaacgtaccccaaatnactgtatttatgagtacaactaaacggcctagtacgggttcaatcgtcttcctcgtgcctacgtaacgtcgtacggccaccgaccggtccctaccctcgacctatcctacgtcggcccagcgngtagacggtacgtacgtcttactacttagttactcgacgtctactactacttaacgaactaacgtacttaacgttactacggttagggttacgtcggggttaccggacggggtcccggtaaccgtcggtaccggtaccgttacgtacgacggtcccgaacgtcgtcccgtcccgtaccgtccgtaccgttccg

SEQ ID NO: 307673 - DNA, 678 bp, Homo sapiens
  misc_feature: GZ8MTXP02H9R6K.39.13.B02.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagtcgcactagtcacgaccggtgctcgatttagtctagcgacttccggcgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatccaccatcctcctgcacgtgaaccagctagtgtacgttggtagttataactatgtctctcgtacaacntacaccaggacaacgtccccaatcgatntattacngagtacaacgtaacgccctagtacgggtttactaacgtcgtacttcctcgtcggtactaccgaagttccgtcggaccaaccgtacccggtacccttaccccgtagaaccctagttcccgtaccgtcgggacccttcggaacggttcgacggaaacgggcccggtaaggtcccttaccttacgttatttaaacgttcggacgtaacgttcctaaacttacggtaacttaaaccgaaagtccttaattacgttaacgtacgggtttaggggtccggttcggggacgggtaaccggggtacctaacggttcgtacccgtaggtttacgaccggaacgtaaccccggacggtccctcccgtacccgttcgtacctccg

SEQ ID NO: 307674 - DNA, 664 bp, Homo sapiens
  misc_feature: GZ8MTXP02HHV9X.39.13.B02.1.454.CMB.2.raw
  modified_base (221)..(221): a, c, t, g, unknown or other
  misc_feature (221)..(221): n is a, c, g, or t
  modified_base (394)..(394): a, c, t, g, unknown or other
  misc_feature (394)..(394): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctctcactcagggcacagggtcctgggcccagtctgccctgactcagcctgcctcgtgtctgggtctcctggacagtcgatcacatctcctgcactggaaccngcagtgacgttggtagttataactatgtctcttggacaacatcaccaggacaaacgtaccccaaatgaacgtgtaatttaagtaggacggttacaaaccgtaaaacccgggtcccctagtacggggtttactaaacgtcggtctttcccgtcgttcggactacgaagttccgngggcaaccgacggtacctccgtagtaccattcctcgtcggccttccgacggtctaggacggacgtacggtcttacgtacttaattacttggacctagtacgtaactaattaaacgtaactaaacggaacgtaacttaagttacgttaacggtttacgggttacggttccggggtacggggtacgggtaccggtaccgtacggtaccgtacgttacggttacgtaaccgtaccgaaccggtaccgtaccgtcccgtaccgtccgttacccg

SEQ ID NO: 307675 - DNA, 740 bp, Homo sapiens
  misc_feature: GZ8MTXP02JKYVF.39.13.B02.1.454.CMB.2.raw
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctctcactcaggcacagggtcctgggcccagtctgccctgactcagcctgcctcgtgtctgggtctctggacagtcatccacatctctgctactggaaccngctagtgtacggttgtagttataactatgtactctggtaccaanactcaccaggacaacgtaccccaactgctagtattatgagtcaactaacggcctacgtacggggtttactaacgtcgtcttaccgtcgtacggtcctaccgtaacgtcgacggcgtaaaaccgcgggtccctacccgttacggaaaccctagttccgtaccggtggggtacccttacccgaacgggtcttcggaacgggtaccgaagggtacccgttcgttactttaccgtttaaagtttcgtaacggaccgtacgttaccctaatttaaaccgtaacccgtaaaacgtaccttaaacgtttacgttaaccggtttacgggtttacggggttaccggttaccgggggtaccggggtaaaccggggttaacccgtaccggttaccggttaacccggtttacggttaaccgggtaaccgaaccggtacccggtaaccggttcccgtacccggttaccccggtaccgttacccgtacccg

SEQ ID NO: 307676 - DNA, 650 bp, Homo sapiens
  misc_feature: GZ8MTXP02JGBBF.39.13.B02.1.454.CMB.2.raw
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcacatctcctgcactggaaccagcagtgacgttggtaggttataactntgtctctgacacatcaccagacaacgtaccccaaatgatgtattangtacgtcaacgtaaaccggcctaggtacgggtttactaacgtcgtcttcctcgtcggcctaccgagtcttacgggacctaaaccgaccggtccctcccgtacgacctacttcctcgtcggccgtaccagggtctagggacgacggtacgtctacttactatttcgtacgcgactactactaagtaactaaccgtaagtcttaactttacgtacgttacggtttacggggttcggttacggggaccgggggtaccgggtaacccggtaccggttacggtacccgtttaccgttacggtaccgtaaccggaccccggtaacggtcccgtaccgtcccccggttcgtcccgtttaccc

SEQ ID NO: 307677 - DNA, 688 bp, Homo sapiens
  misc_feature: GZ8MTXP02F6LXT.39.13.B02.1.454.CMB.2.raw
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
tcagtcgcactagtcacgaccggtgctcgatttagtctagcgacttccgcgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgatatgtctcgtgtaccngacaatatccagccacaccgaccccaatcatactatttancgtagtacagtacgtccggccgtgtacggttactactcgtcttctcgtgtacctcagtctacggaccaaccgaccgtccctacccctacggaaccctgttacccgtcgtacgggcccgttaaccgcggaccgttaggaaccggggtcaccggttccgttaagttactttaaacgttcagtaccgtacgtccttaccgttaggttcacccggttaaatccgtaaggttacggtaccggtttaacgtttacggtttacggtcccgggttttaaaaccgggacggggttacccggtaaaacccggtacggttacccgtaacggtttccccggtaaccggttacgggttaccccaaaaccgggtccccggttaaaaccccgggaacccccg

SEQ ID NO: 307678 - DNA, 554 bp, Homo sapiens
  misc_feature: GZ8MTXP02F43Q3.39.13.B02.1.454.CMB.2.raw
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactaggaaccagcgagtgtacgttgggtagttaataactatgtctctgtaccaacactccaccgagacaacgtacccaatnatntattangagtcacgtaacgcctgtaggttctatcgtnttcntgctcagtcncgcacncgtcctcctgactctctcgtgctacgagtcgngacgacgngctctctattagtgactacgtctanattaacaacgatcctaattaccgttntaacgggttgggtacggttacgggaccggtacgggtacccgtacttacggtaccgttacgtacgtcgaaccgtacccgacggaccctccggtaccctcggtacctccg

SEQ ID NO: 307679 - DNA, 676 bp, Homo sapiens
  misc_feature: GZ8MTXP02HAYYG.39.13.B02.1.454.CMB.2.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagtcgcactagtcacgaccggtgctcgatttagtctagcgacttccgcggggggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcgatcacntctcngcactggaaccagcagtgtacgttggtagttaataactatgtctctacggtaccaacatccaccgagaccaaacgaccccaaangatgtattangagtcaacaacgtcctgtaggttactagtcgtcttccgtctcgtctactagtcgtaggtaccaacgtaccggtccccttccctacgaccctagttcccttcgtcgggtacccttccgaaggtccgtaggaacggtaccgaggtccttactacttagtttacgttcggaacctgttactacgtaataactaaaccgaataccttaaatttacgtaccgttaagggtttcgggttacgggtttacgggaccggggtaaccgggtaaacccggtccgttaacggttaccccggttacgttacggtaccggaacccggtaacccgtaacgggtcccgttacccccggtcccccggttaccggtacctttaaccccgg

SEQ ID NO: 307680 - DNA, 592 bp, Homo sapiens
  misc_feature: GZ8MTXP01CELWP.45.56.F01.1.454.CMB.2.raw
  modified_base (398)..(398): a, c, t, g, unknown or other
  misc_feature (398)..(398): n is a, c, g, or t
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
tcagacgcgatcgacacgaccggtgctcgatttagcagacgtctgccgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaaagtgggtccgcaggctccgaggggaaggggctggagtgggtctcatccattagcagtagccaggtgtcacataatattaacgcaagactcaggtacgaaacggggcccncttacaaactctacctacccaagaacgaaccaaacggcccaaagaacctcaactgtaatactaaacaaatagaaaccagtactaggaagacgaccggaggaccgacgggtcttggtttaactacgttagtaaaccgngaaccgnggacgtcttaaagtaagggttcttttaggagttgggttggtaaccggggg

SEQ ID NO: 307681 - DNA, 545 bp, Homo sapiens
  misc_feature: GZ8MTXP01AGKYF.45.56.F01.1.454.CMB.2.raw
  modified_base (397)..(397): a, c, t, g, unknown or other
  misc_feature (397)..(397): n is a, c, g, or t
  modified_base (447)..(447): a, c, t, g, unknown or other
  misc_feature (447)..(447): n is a, c, g, or t
  modified_base (535)..(535): a, c, t, g, unknown or other
  misc_feature (535)..(535): n is a, c, g, or t
tcagacgcgatcgacacgaccggtgctcgatttagcagacgtctgcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaagtggtccgcaggctccgagggaggggctggagtgggtctcatccattagcagtagccagtggtcacataatattaacgcagactcgaggtgaacgggtccacttacaacntctaccagacgacacgacaaagactcactgtactctaacaaatcgaaacngttcaggaacgcggcccggaaggaccgacgggtcttagtttacacgttagtaacgagacgagagtaactagtaaggtctttgattggnggtaacgggg

SEQ ID NO: 307682 - DNA, 690 bp, Homo sapiens
  misc_feature: GZ8MTXP02ITG65.45.56.F01.1.454.CMB.2.raw
  modified_base (522)..(522): a, c, t, g, unknown or other
  misc_feature (522)..(522): n is a, c, g, or t
tcagacgcgatcgacacgaccggtgctcgatttagcagacgtctggtcggcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcgggggagccgtggtcaagccgtgggggtccctgagactctcctgtgcagtctcgtggattcgacttcagttatttatagtgtagaaagtcgggtccgccgaggcctaccggaaggggaacgggggctacggggaggttcggggtctacgacttcccagtttagcctaggtacgccgaggttcggtacactataattagttaccgctaacgtacctacgaggttagggaaacgggcccggtaccttacgaaactattccgtaccaagaacgaccaaaccgacctaaaagacctacaacttacgtaactaacttaaanaaactaggaaactacgtacgtacggaaggaacgaccggaaacgggaaccgtacggtactttacgtttaccgttaacgtacggttaaacgacgaaaccgtaagacggtaaccgttaaagtaacggtttaccgttttacggacgtttacggggtacgggttaaccggggg

SEQ ID NO: 307683 - DNA, 519 bp, Homo sapiens
  misc_feature: GZ8MTXP01EGOB3.22.65.F10.1.454.CMB.2.raw
  modified_base (215)..(215): a, c, t, g, unknown or other
  misc_feature (215)..(215): n is a, c, g, or t
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (408)..(408): a, c, t, g, unknown or other
  misc_feature (408)..(408): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataaacgtactatttaaatggtatcagcagaaaccaggaaagcccctaagctcngatctatgctacttccagtttgactaaaggtgggtcctnaaaggttcagtggcagtgatcgtgggaacagtattcactctcacatccgcgtctgcaacctgaaagtatttcgactaaacttactaactntacaacgataacttacacgtccgccccccgaatccaaccgttcgaccaaagggaccacgaactggaagtaattaaacgaactgttagcttcgcacaatctnttctcnctcg

SEQ ID NO: 307684 - DNA, 598 bp, Homo sapiens
  misc_feature: GZ8MTXP01CPG4Q.22.65.F10.1.454.CMB.2.raw
  modified_base (221)..(221): a, c, t, g, unknown or other
  misc_feature (221)..(221): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacgatcccaggatgacccagtcgtccagtcctaccgtgtctagcatctgtagagacagagtcacatcacctgccggganaagtcagagacataacgtactaatttaagtgtactcagacaagaaacgaggaactccctaagctctagactactatcgtctacttactagttagtacgtaacggtacgggtccgtacgtacgtacgtacgtaggtagagtgtagtacgtacggcgtagtattactactctacactactccgtcgtcgtcgtactacgtacgtaagtacttacgtactaacttactactactactaacgtaacgtaactaactacgtacccgtaccccgtacctacctaccgtaccgtaccgaacggacgacgtaacgtacggaacgtaacgttaaacgtaacgtagttcgttcgttacgtaacactaactctcttacttcgttctcc

SEQ ID NO: 307685 - DNA, 534 bp, Homo sapiens
  misc_feature: GZ8MTXP01C5MCG.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaacgcccctaagctcctgatctatgctacttccagttttgactaaaggtggggtcccgtacaaaggtttcaacggtggcaggtggatcgtgggaacagtatttcactctcaccatccgcgtctgcaacctgaagtatttcgactaacttactactgtacaacagtacttacacgtccgccccccgatccacccttcggccaaagggaccacgaactaggagaacttaaacgaactgttacggcttcgcacaactctcttcttcaattccc

SEQ ID NO: 307686 - DNA, 529 bp, Homo sapiens
  misc_feature: GZ8MTXP01EQ5GN.22.65.F10.1.454.CMB.2.raw
  modified_base (325)..(325): a, c, t, g, unknown or other
  misc_feature (325)..(325): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactatttaaatggtatcagcagaaaccagggaaagcccctaaagctcctgatctatgctacttccagtttgactaaaggtgggggtcccctnaaaggttcagtggacaggtggatcgtgggcagtatttcactctcacatccgcggtctgcaacctgaaagtatttcgacaacttactactgtacaacagtacttacacgtccgaccccccgatccaccttcggaccaaagggacaacgaactggaagaacttaaacgactgttcggcttgcacctaatctgttcttcaacttccc

SEQ ID NO: 307687 - DNA, 525 bp, Homo sapiens
  misc_feature: GZ8MTXP01BCOMR.22.65.F10.1.454.CMB.2.raw
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatgtatcagcagaaaccagggaaagcccctaagctcctgatctatgctacttccagtttgcaaaggtgggtcctnaaggttcagtggcagtggatcgtgggcagtatttcactctcaccatccgcgtctgcaactgaagtatttcgactaacttactactagtaccaactacgtaacttacacgtccgccccccgatccaccttcggaccaacgggacacgaactaggagtacttaaacgaacgtgttacggcttgcaccaatctgttacttcgttaacttccc

SEQ ID NO: 307688 - DNA, 528 bp, Homo sapiens
  misc_feature: GZ8MTXP01C6TMF.22.65.F10.1.454.CMB.2.raw
  modified_base (215)..(215): a, c, t, g, unknown or other
  misc_feature (215)..(215): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataaacgtactattaaatggtatcagcagaaaccagggaaagccccctaaagctcctgatctatgctacttccagtttgcaaaggtggggtccctcaaggttcagtggcagtggatcgtgggaacagatttcactctcaccatccgcggtctgcaacctgaagtactttcgacaaacttactactagttacaacaacgtactttaaccacgtccgacccccccgatccaaccttcggacccaagggacacgaactggagaattaaacgaactgttaggcttgcaccntctgttcttcnttccc

SEQ ID NO: 307689 - DNA, 576 bp, Homo sapiens
  misc_feature: GZ8MTXP01DZYL5.22.65.F10.1.454.CMB.2.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (267)..(267): a, c, t, g, unknown or other
  misc_feature (267)..(267): n is a, c, g, or t
  modified_base (325)..(325): a, c, t, g, unknown or other
  misc_feature (325)..(325): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagancataaacgtatattaaatggtatcagcagaaaccagggaaacncccctaagctcctgatctatgcttaacttccagtttgactaaaggtgggggtccctanaaggttcagtggcagtggatcgtgggaacagtatttcactctcaccatcccggngtcngacactagtaagtattactactaacttactactactacaacgtaactaacttacctacgtacccgtaccccgtacctacctaccgtaccgtaccgaacggaacgaacgtaacgtaacggttaagtaaacgttaaacgtaaacgtacgttacgttcgttacgaacacctaacttcttcgttcttcttcgttccg

SEQ ID NO: 307690 - DNA, 513 bp, Homo sapiens
  misc_feature: GZ8MTXP01B3W2Z.22.65.F10.1.454.CMB.2.raw
  modified_base (214)..(214): a, c, t, g, unknown or other
  misc_feature (214)..(214): n is a, c, g, or t
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactatttaaatggtatcagcagaaaccagggaaagcccctaagctcctgatctatgctacttccagtttgcaaagtgggtccctnaaggttcagtggcagtggatctgggcagtatttcactctcaccatccgcggtctgcaacctgaaagtatttcgactaacttactactagtacaacgagacttacacgtcgccccccgatccaccttcggccaagggaccacgaactcggagattaaacgaactgttcggcttcgcacaatctgttcttcaacttccc

SEQ ID NO: 307691 - DNA, 592 bp, Homo sapiens
  misc_feature: GZ8MTXP01EFLPA.22.65.F10.1.454.CMB.2.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataaacgtactatttaaatggatcagcagaaaccagggaaacncctaanctcngatctatcgtactacttcgtagtttcgacgtaaggtcgggtccctagtaaggttcacggtcggactaggtggtactcggtagggaactagtactttccacgtctacgactacgtcccggcgtctacgacaacgtacgtaacgtacgttacgtactaacttactactacgtactaacgtaacgtaacttaacgtacgtaccgtaccccgtacctaccgtaccgtaccgtaccgaacggacgacgaacgtacggagtaaacgttaaacgtaacgtacgttcggttcgttcgcactaactctcgttcttcttctccg

SEQ ID NO: 307692 - DNA, 552 bp, Homo sapiens
  misc_feature: GZ8MTXP01EFPPL.22.65.F10.1.454.CMB.2.raw
  modified_base (536)..(536): a, c, t, g, unknown or other
  misc_feature (536)..(536): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataaacgtactaatttaaattggtatcagacagaaaccaagggaaacgcccctaaagcctcctgatctatgctacttccagtttgactaaaggtcggggtccctcgaaaggttcaggtggcaggtggatcgtgggaacagtatttcacttctcaccatccgcggtctagcaacctgaaacgtatttacgactaaacttactaactatacaaacacgtaacttacacgtccgccccccgatccaccttccggaccaacgggacacgaactaggagtaacttaaacgaactgttacggcttgcacaactctnttcttcttaacttccc

SEQ ID NO: 307693 - DNA, 512 bp, Homo sapiens
  misc_feature: GZ8MTXP01CN7MD.22.65.F10.1.454.CMB.2.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (322)..(322): a, c, t, g, unknown or other
  misc_feature (322)..(322): n is a, c, g, or t
  modified_base (506)..(506): a, c, t, g, unknown or other
  misc_feature (506)..(506): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactatttaaatggtatcagcaagaaacagggaaacncccctaagctccngatctatgctacttccagtttgacaaaggtcgggtccctanaaggttcagtggcagtggatcgtgggaacagtattcactctcacatccgcgtctgcaactgaagtattcgactaaacttactactgtacaactagtacttacacgtccgcccccgatccacctcgaccgaaggaccacgaactggagtacttaaacgaactgagcttcgcacaatctgttctcncttccc

SEQ ID NO: 307694 - DNA, 506 bp, Homo sapiens
  misc_feature: GZ8MTXP01CGRP8.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactatttaaatggtatcagcagaaaccagggaaagccccctaagctcctgatctatgctacttccagtttgcaaagtgggtcccgtcaaggttcagtggcagtggatctgggcagatttcactctcaccatccgcggtctgcaacctgaagatttcgctaacttactactgtacaacagacttacagtcgcccccccgatcaccttcggccaagggacacgaactggagattaaacgaactgaggcttgcaccaatctgttcttcaacttccc

SEQ ID NO: 307695 - DNA, 560 bp, Homo sapiens
  misc_feature: GZ8MTXP01DKKC7.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaaagtcagagcaataaacgtactatttaaatggtatcagcagaaaccagggaaagcccctaagctcctgatctatgctacttccagttttgcaaaggtggggtcccgtcaaaggttcagtggcagtggatctgggcagatttcactctcacatccgcggtctgcaacctgaagtatttcgactaaacttactaacttatacaacgtacgtaacttacacgtcccgccccctactacctaccgttccgaccgaacggaccacgtaacgtaggaagtaaacgttaaacgtaacgtggttacggttcttcgaaccacctaacttctcgttaccttccttaacttcccg

SEQ ID NO: 307696 - DNA, 509 bp, Homo sapiens
  misc_feature: GZ8MTXP01AC0WJ.22.65.F10.1.454.CMB.2.raw
  modified_base (485)..(485): a, c, t, g, unknown or other
  misc_feature (485)..(485): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaaagcccctaaagctcctgatctatgctaacttccagtttgcaaagtggggtccctcaaaggttcagtggcagtggatctgggaacagatttcactctcaccatccgcggtctgcaacctgaagatttacgcaacttactactgtcaaacagacttacacgtcgccccccgatccaccttcggccaagggacacgaactggagattaaacgactgttggnttgcacaatctgttcttcaattcc

SEQ ID NO: 307697 - DNA, 545 bp, Homo sapiens
  misc_feature: GZ8MTXP01BY8KA.22.65.F10.1.454.CMB.2.raw
  modified_base (323)..(323): a, c, t, g, unknown or other
  misc_feature (323)..(323): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagcaataacgtactatttaaatggtatcagcagaaaccagggaaacgcccctaagctcctgatctatgctacttccagtttgctaaaggtggggtccctnaaggttcagtggcaggtggatcgtgggcagtatttcactctcacatccgcggtctgcaacctgaagtatttcgactaacttactactgtacaaacgagtacttacacgtcccgccccccgatcctacccgttccggcccgtaaacgggaccacgaactagggaacgtaacttaaacgaacgtggacggcttaggcaccaattctgttccttcttaacttccc

SEQ ID NO: 307698 - DNA, 518 bp, Homo sapiens
  misc_feature: GZ8MTXP01BALMC.22.65.F10.1.454.CMB.2.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccattacctgccgggnaagtcagagcataacgtactatttaaatggtatcagcagaaaccagggaaanccctaagctctgatctatgctacttcagtttgcaaagtgggtcctnaaggttcagtcggcagtggatcgtagggacngatttcactctcacatccgcgtctgcaacctgaagtatttcgactaacttactaactgtacaacaggtactttaacgacgttccgaccccccgatccacccgttcggacctaaacgggacacgactggagattaaacgactgtggcttgcaacatctgtcttctaacttctccc

SEQ ID NO: 307699 - DNA, 578 bp, Homo sapiens
  misc_feature: GZ8MTXP01EJ2S1.22.65.F10.1.454.CMB.2.raw
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataaacgtactatttaaatggtatcagcagaaaccagggaaacncccctaaagctcctgatctatgctacttccagtttgactaaagtggggtccctnaaggttcagtggcagtggatcgtgggaacagtatttcactctcacctatcccgcgtctgcaacctgaaagtatttcgactaaacttactactattacaaactacgtaactttaacacgttccgacccccccgtatcctaacccgttccggacccgaaacggggaccaacggaaccgttggaaaggtaactttaaaacggaaacgttgttacggcttacgcctacccaagttcctgttaccttcttaactttccccg

SEQ ID NO: 307700 - DNA, 526 bp, Homo sapiens
  misc_feature: GZ8MTXP01D8TB4.22.65.F10.1.454.CMB.2.raw
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataaacgtactatttaaattggtatcagcagaaaccagggaaagcccctaagctcctgatctatgctacttccagtttgacaaagtgggtccctnaaggttcagtggnagtgatctgggcagatttcactctcacatcgcgtctgcaactgaagtatttacgctaacttactactacgtacaacacgtaactttacacgttccgcccccccgtatcctaacccgttcggaccgaaacggggaccaacgaactggaagtaattaaacgaactgttggcttgcaccaatccgtnttctcnctcc

SEQ ID NO: 307701 - DNA, 592 bp, Homo sapiens
  misc_feature: GZ8MTXP01DL0NL.22.65.F10.1.454.CMB.2.raw
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactatttaaatggtatcagcagaaaccagggaaacncccctaagctcctagatctatgcttacttccagtttgacgtaaaggttcgggggtccccttacgaaaggtttcaaggttcggactaggtggaatcgtaggggaacagtatttcactctcacatcccgcggtctgacaacctagaagtatttcgactaacttactactagtaccaacgtaacgtacttaacacgttcccgcccccccgtatcctacccgttaccggaccgaaacgggaccaacgtaacgtacggaagtaaacttaaacggaaacgtgttcgggcttaggccacctaacttctcgttcctttcgaactttccccg

SEQ ID NO: 307702 - DNA, 722 bp, Homo sapiens
  misc_feature: GZ8MTXP01B4PA1.22.65.F10.1.454.CMB.2.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (446)..(446): a, c, t, g, unknown or other
  misc_feature (446)..(446): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggnaagtcagagcataacgtactatttaaatggtatcganagaacgaacgaaggaaccacctaagcctacgagtactactagtcgtaccttaccttacgttaggttcgaaacgtaagggggttccgggttaccctaaggtacgttcgaagggtccggagtagggtagtacgttacgggacgggaacgtagtttacctttaccaccctttcctacccaactccgtcccggtcgttcncgaacctaacgtaggaaactttcgttaccaaccttaacttacttacgtacttaaccaaacggtacttaaccttaacgcccgtaccccccgacccccttataccccgttaaccggtcccggaaaccggaacggaacccgtacgtaaccgtagggttaaacttaaaacgtttaaacccggaacgtttgggggaaccccgttcgttacccgtaaccctaacccgttaacgtttcccggtttaccgtttaccctttaacccgttaacccggtttcccccg

SEQ ID NO: 307703 - DNA, 571 bp, Homo sapiens
  misc_feature: GZ8MTXP01DNGOQ.22.65.F10.1.454.CMB.2.raw
  modified_base (216)..(216): a, c, t, g, unknown or other
  misc_feature (216)..(216): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaatggtatcagcagaaacagggaaacncccctaagctcctgatctatgacttacttcctagtttgacgtaaaggtcgggggttccctagaaaggttcaggtggcaggtggatcgtgggcagtatttcactctcaccatccgcgtctgacaacctgaagtactttcgactaaacttactactagtacaaactacgtaactttacacgtacccgaccccccgatacctaccgttccggaccgaaacggggaccacggaacgtaggaagtaacgttaaacgaacgtcggttacggcttcgcctacctaattctcgttcttccttaactttcccg

SEQ ID NO: 307704 - DNA, 595 bp, Homo sapiens
  misc_feature: GZ8MTXP01BJDCV.22.65.F10.1.454.CMB.2.raw
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctggccgggcaagtcagagcaataaacgtacttaatttaaattggtatcagacaagaaaccgagggaacgcccctaagctcctgatctatcgacttacttcctagtttcgacgtaaagggttcgggggttcccgtacgtaaaggggtttcaaggttgggacgtagggttgggacttaccggttaggggaactaggttacttttccacttcctacacctactcccggcggtctgacctaaccgtgtaaagtactttacgactaacttactactgtacaacgtacgtacttacacgtccgcccccgtatcccgaccgttccgaccgaacggaccacgaacgtagagtaacttaaacgaactgttgcttgcactntctnttctcttcgttccc

SEQ ID NO: 307705 - DNA, 571 bp, Homo sapiens
  misc_feature: GZ8MTXP01CZLU9.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggacaagtcagagacaataaacgtactaatttaaattggtatcagacaagaaaccaagggaaacgcccctaaagctcctagatctatcgcttacttcctagtttcgacgtaaaaggttcgggggtaccctacgaaaggtttcaaggttgggacaggtggatcgtaggggaacagtatttcactctcacatccgcggtctcgacaacctagaaagtactttacgactaacttactactagttacaaactagaacttacacgtccgaccccccgatccaccgttcggaccgaaggaccacgaacgtggaagtacttaaacgaactggaggcttagcacaattctcttcttcaactttccc

SEQ ID NO: 307706 - DNA, 581 bp, Homo sapiens
  misc_feature: GZ8MTXP01DSRIL.22.65.F10.1.454.CMB.2.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataaacgtactatttaaatgtatcagcagaaacagggaaancccctaagctcctagatctatgcttacttcctagtttgactaaagtcgggtccctnaaggttcagtggcagtggatcgtgggaacngtatttcactctcacatccgcgtctgcaactgaaagtatttcgactaacttactactagtacaaactagtaacttaacacgttccgccccccgattcccgtaacccgttccggtacccgaaacggggaccaacgtaacgtagggaagtaaacgtttaaacggaaacgtggttacgggcttacggaacctaaccctaagttcctggttacctttcgttaacgtttccccg

SEQ ID NO: 307707 - DNA, 693 bp, Homo sapiens
  misc_feature: GZ8MTXP01A8VVT.22.65.F10.1.454.CMB.2.raw
  modified_base (190)..(190): a, c, t, g, unknown or other
  misc_feature (190)..(190): n is a, c, g, or t
  modified_base (273)..(273): a, c, t, g, unknown or other
  misc_feature (273)..(273): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcacatcacctgccggcaagtcagagcaataaacgtacttaatttaaattggtatcagacaagaaaccgagggaaacncccctaaagcctcctagatctatcgaccttacttccgtagtttgacgtaaagggttcgggggtacccctagtaaacgggttccgaaggttgggactagggtcggtaagttccgtaggggaacctaaggtacttttcccaaccttcccttaccaacccctacgttccccggtccgggttctacggtacctaaacccgttaggtaaacgttacgtttaccgacttaaaccttaactaacttacgttaaccaaacgtaacgtaaccttaaccgtaccgtacccgacccccccgtattcccgtaacccgttccggaacccgaacgggaccaacgtaaccggtagaaacgtaaacttaaacgtaaacgtggttacggttcttacgaacctacctaacttcttacgttccttcgaacgtttccccg

SEQ ID NO: 307708 - DNA, 581 bp, Homo sapiens
  misc_feature: GZ8MTXP01DIHZX.22.65.F10.1.454.CMB.2.raw
  modified_base (215)..(215): a, c, t, g, unknown or other
  misc_feature (215)..(215): n is a, c, g, or t
  modified_base (376)..(376): a, c, t, g, unknown or other
  misc_feature (376)..(376): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataaacgtactatttaaattggtatcagcaagaaaccagggaaacgcccctaagctcctgatctatgcttaacttccagtttgacaaaggtgggggtccctagaaggtttcaggtggacaggtggatcgtgggcagtatttcactctcacntccgcgtctgcaactagaaagtatttcgactaacttactactagtacaacacgtacttaaccacgttccgaccccccgatcctaacccgttccggaccgaaacggggacaacggaacgtacgggaaagtaaacgttaaacgaaacgttggttacgggttcttacggcctaaccgtaattctcgttcctttcttaacgtttccccg

SEQ ID NO: 307709 - DNA, 529 bp, Homo sapiens
  misc_feature: GZ8MTXP01DQYRO.22.65.F10.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (410)..(410): a, c, t, g, unknown or other
  misc_feature (410)..(410): n is a, c, g, or t
  modified_base (480)..(480): a, c, t, g, unknown or other
  misc_feature (480)..(480): n is a, c, g, or t
  modified_base (514)..(514): a, c, t, g, unknown or other
  misc_feature (514)..(514): n is a, c, g, or t
tcagacatacgcgtcacgaccggtgctcgatttagctacgctctaagggggagtcagtctcagtcaggacacagcatggacatgagggtccccgctcacctcctggggctcctgctactctggctccgaggtgccagatgtgacatccagatgacccagtctccatccctcctgtctgcatctgtagganacagagtcaccaatcacctgccgggnaaagtcagagcaataacgtatatttaaatggtatcagcagaaaccagggaaancccctaaagctcctgatctatgctacttcagtttgnaaagtggggtccctnaaggttcagtgcagtggatcgtgggacngatttcactctcacatccgcggtctgcaacctgaaagtatttcgactaaacttactaccgtntacaaaccagtaactttacaacgttcgaccccccgtatccaccttacggaccaagggacacgactggganaattaaacgaacgtgtggacttgacaacatcttntcttctcttccgtcc

SEQ ID NO: 307710 - DNA, 592 bp, Homo sapiens
  misc_feature: GZ8MTXP01AETKA.22.65.F10.1.454.CMB.2.raw
  modified_base (224)..(224): a, c, t, g, unknown or other
  misc_feature (224)..(224): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagancataacgtactatttaaatgtatcagcagaaaccagggaaacgcccctaagctcctgattctatgctactttccagtttgacgtaaagggttcggggtacccgtacaaagggttcaaggtcggacaggtggattcgttaggggaactaggtacttttcaccttctacaacccgtacgtcccggcggttccttaggacctaaaccgttagaaacgtactttaccgacctaaactttactactagtacaaactagtaccttacacgtccgcccccgatccgtaccttcggaccaacgggacacgtaactgggaataacttaaactaacgtgttcggacttcgcactaattccttcttcttcgttcttccc

SEQ ID NO: 307711 - DNA, 575 bp, Homo sapiens
  misc_feature: GZ8MTXP01DL700.22.65.F10.1.454.CMB.2.raw
  modified_base (333)..(333): a, c, t, g, unknown or other
  misc_feature (333)..(333): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactatttaaatgtatcagacaagaaaccagggaaacgcccctaagctcctagatctatcgacttacttcctagtttgactaaaggtcggggtacccctanaaaggttcagtggacaggtgatcgtagggcagtatttcactctcacactccgcgtctcgacaacctagaaagtactttacgactaaacttactactactacaaacgataacttaccaacgtcccgaccccccgatccctacccgttccggaccgaaacggggaccaacgaacgtaggaagtaaacttaaacgaaacgtcggttaggcttacgccactaactctcttcttcttaacttccccg

SEQ ID NO: 307712 - DNA, 520 bp, Homo sapiens
  misc_feature: GZ8MTXP01EZ9GE.22.65.F10.1.454.CMB.2.raw
  modified_base (324)..(324): a, c, t, g, unknown or other
  misc_feature (324)..(324): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactatttaaatggtatcagcagaaaccagggaaacgcccctaagctcctgatctatgctacttccagtttgacaaaggtcggggtccctanaaggttcagtggcagtggatcgtgggaacagtatttcactctcaccatccgcgtctgcaacctgaagtatttcgactaacttactactagtacaacagtacttacacgtccgccccccgatcctacctcggaccaacgggacacgaactggagaattaaacgaactgttgcttgcacaatctgttcttcttcttcc

SEQ ID NO: 307713 - DNA, 574 bp, Homo sapiens
  misc_feature: GZ8MTXP01A3NDB.22.65.F10.1.454.CMB.2.raw
  modified_base (213)..(213): a, c, t, g, unknown or other
  misc_feature (213)..(213): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggnaagtcagagcataacgtactatttaaatggtatcagcagaaacagggaaagcccctaagctcctgatctatcgtctacttccagtttgactaaaggtgggggtccctacaaggttcaggtggacaggtggattcgtggggaactaggattttcacttcctacacctactccgcggtctgcaaacctgaacgtctttacgactaacttactactagtacaaacacgtacttacacgtccgcccccgtatcctaccgttcggaccaaaggggaccaacggtaactagggaagtaacttaaacgaaacgttgttacgggttcttcggaacctaccgaacttccttcgttaccttcgttcgtccg

SEQ ID NO: 307714 - DNA, 531 bp, Homo sapiens
  misc_feature: GZ8MTXP01AQR0M.22.65.F10.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagancataacgtactatttaaattggtatcagcagaaaccagggaaagcccctaagctcctgatctatgctacttccagtttgcaaaggtggggtacccgtgaaaggttcagtggcagtgggatcgtgggaacagtatttcactctcacatccgcggtctcgcaacctgaagtattcgactaacttactactgtacaacacgacttacacgtccgccccccgatccaccgttcgaccgaagggaccacgaactggagtaattaaacgaacctgacggcttggccacaatctcgttcttccttaacttccccg

SEQ ID NO: 307715 - DNA, 636 bp, Homo sapiens
  misc_feature: GZ8MTXP01DY79N.22.65.F10.1.454.CMB.2.raw
  modified_base (217)..(217): a, c, t, g, unknown or other
  misc_feature (217)..(217): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatcacctggccggnaagtcagagcaataacgtataattaaatgtatcagacaagaaacgagggaaacgcccctaagctcctagatctatgtactacttcctaggtttgacgtaaagggtcgggggttaccctgtaaaggttcaaggtggactaggtggatcgtaggggaactagtatttccaacttcctacaacctagtcccggcggttctacgacctaaaccgtaggtaaacgtactttacgactaaacttaacctaactactaaccaaacgtaacgtaacctttaaccaccgttcccgacccccccgtagtaccctacccgttcggacccgaaaggggaccaacggtaacgtaggaacgtaaacgttaaacgaaacgtcggttacggcttacggaaccacctaactcttcgttaccttcttaacgttcccg

SEQ ID NO: 307716 - DNA, 676 bp, Homo sapiens
  misc_feature: GZ8MTXP01D9OXS.22.65.F10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgccggnaagtcagagcaataacgtatatttaaatggtatcagacaagaaaccgagggaaacgcccctaagctctgatctatcgtacttacttcctagtttcgacgtaaagggtcggggtaccctagaaaggttcaggtggactaggtggatcgtagggaacagtatttccacttcctacacctacgtcccggtcgtctcgacctaaccgtagtaaacgttactttaccgactaaaccttactaacgttacgtaacctaaacgtaacgttaacctttaaccgtaccggttaccccgacccccccgtaacttaccccgtaaccccggttaccgggtaaccccgtaaacgggggtacccaaacggtaaccgtaaggggaaacgtaaacgttaaaacgtaacgttacgggttacggttccgttacggaacctacctaacttccgtcgtttaccttaaccttaacgtttccccg

SEQ ID NO: 307717 - DNA, 626 bp, Homo sapiens
  misc_feature: GZ8MTXP01B3OY7.22.65.F10.1.454.CMB.2.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
tcagacatacgcgtcacgaccggtgctcgatttagctacgctctaagggggagtcagtctcagtcaggacacagcatggacatgagggtccccgctcacctcctggggctcctgctactctggctccgaggtgccagatgtgacatccagatgacccagtctccatcctcctgtctgcatctgtaggagacagatcacatcacctgccggnaagtcagancaataacgtatattaaattggtatcagacaagaaaccgagggaaacnccctaaagctcctgatctatgctacttctagtttgacgaaaggtcggggtaccctagaaggttcaggtcggcaggtggatcgtagggacngtactttcactctacacatcccgngtcngacaacgtgaagtactttacgactaacttactactgtacaaactacggtaacctttacaccggtaccccgacccccgtatacccgtacccgttaccggaccgtaaacggggaaccaccggtaacgtaacgggaaacgttaaacgtttaaaacccggagttacgggtacgggttccgttacggaccctaacctactttcccttcggttacctttacctaacctttccccggtttaacccccg

SEQ ID NO: 307718 - DNA, 550 bp, Homo sapiens
  misc_feature: GZ8MTXP01A4SFD.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataaacgtactatttaaatggtatcagcaagaaaccagggaaacgcccctaagctcctgatctatgctacttccagtttgactaaaggtcgggggtcccctacgtaaaggtttcaaggttgggacaggtggatcgtggggaacaggtatttcactctacacctatccgcggtctgcaaccttgaagtatttcgactaacttactaactagtacaactagtacttacacgtccgcccccgatccaccgttcggaccaagggaccacggaactggagtaattaaacgaactgttaggcttgcaccaatctcgttcttcaacttccc

SEQ ID NO: 307719 - DNA, 575 bp, Homo sapiens
  misc_feature: GZ8MTXP01EW5CS.22.65.F10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacctgccggnaagtcagagcataacgtactatttaaatggtatcagacagaaaccagggaaacncccctaagctcctgatctatgctaacttccagtttcgactaaaggtcgggggtaccctagtaaagggttcaggtggacaggtggatcgtagggcagtatttcactctacacctatccgcggtctgccaacgtgaaacgtactttacgactaaccttactactagtacaactagtaaccttacgacgtcccgccccccgtatacctacccgttcggaccgaacgggaccaacggaactaggaagtaacttaaacggaacgtggttacgcttacgctaccaacgttctcgttaccttcgttaacttcccg

SEQ ID NO: 307720 - DNA, 558 bp, Homo sapiens
  misc_feature: GZ8MTXP01EJUOX.22.65.F10.1.454.CMB.2.raw
  modified_base (214)..(214): a, c, t, g, unknown or other
  misc_feature (214)..(214): n is a, c, g, or t
  modified_base (324)..(324): a, c, t, g, unknown or other
  misc_feature (324)..(324): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccggnaagtcagagcaataacgtactattaaatggtatcagcaagaaaccaggaacgcccctaagctctgatctatgcttacttccagtttgacgtaaaggtcggggtaccctanaaagggttcaaggtggacaggtgatcgtagggaactagtaactttcacttctacacctatccgtcggtctagacaacctagaagtatttacgactaacttactactagtacaacgaagtacttacacgtccgacccccgatcctaccgtcgaccgaaggaccaacgaagtacggagtaaacttaaacgaactgttcggcttgaacacctaattctcttcttcgttaacttcccg

SEQ ID NO: 307721 - DNA, 589 bp, Homo sapiens
  misc_feature: GZ8MTXP01B2FUH.22.65.F10.1.454.CMB.2.raw
  modified_base (326)..(326): a, c, t, g, unknown or other
  misc_feature (326)..(326): n is a, c, g, or t
  modified_base (378)..(378): a, c, t, g, unknown or other
  misc_feature (378)..(378): n is a, c, g, or t
  modified_base (569)..(569): a, c, t, g, unknown or other
  misc_feature (569)..(569): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactattaaattggtatcagcagaaaccagggaaacgcccctaagctcctgatctatgctacttcctagtttgactaaagtcgggggtccctanaaggttcagtggcagtcggatcgtgggaacagtatttcactctcacatccgnggtctgctaacctgaaagtactttacgactaacttactactgtaccaaactacgtaactttaacacgttcccgacccccccgtatcccgtaacccgttccggacccgaaacggggaccaacggtaaccgtagggaagtaaacgtttaaaacgaaccgttggttacggttcttcggaacctacccaattctnttaccttcgaactttccccg

SEQ ID NO: 307722 - DNA, 592 bp, Homo sapiens
  misc_feature: GZ8MTXP01EC846.22.65.F10.1.454.CMB.2.raw
  modified_base (274)..(274): a, c, t, g, unknown or other
  misc_feature (274)..(274): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactaatttaaattggtatcagacaagaaaccaagggaaacncccctaagctcctgatctatgacttacttccagtttgactaaaggttcgggggtacccctagaaaggtttcaaggttgggactaggtgggattcgtaggggaactagtatttcacttctacacctatcccgcggtctcgcaacctgtaagtactttcgactaacttactactagtacaacacgtacttaacacgtccgaccccccgatccgtacccgttcggacccgaaacgggaccaacggaactagggaagtaaacgttaaacgaacgtggttcggcttacgaaccacctaactctcgttcttccgttaacttccc

SEQ ID NO: 307723 - DNA, 580 bp, Homo sapiens
  misc_feature: GZ8MTXP01DD5DF.22.65.F10.1.454.CMB.2.raw
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaaagtcagagcaataacgtatattaaatggtatcagcaagaaaccagggaaacncccctaaagctcctgatctatgcttaacttccagttttgacgaaaaggttcgggggtaccccctagtaaagggtttccaacggttgggactaggttggaatcgtaggggaacagtattttcactctcacatccgcggtctgacaacctgaagtatttcgactaaacttactactgtacaaacagtaacttacacgtccgacccccgtataccaaccgttcggaccgaaacggggaccaacggtaactagggaagtaaattaaaaccgaaatggttcggcttcgaacacctaatctcttcttcaacgttccc

SEQ ID NO: 307724 - DNA, 587 bp, Homo sapiens
  misc_feature: GZ8MTXP01EROUR.22.65.F10.1.454.CMB.2.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcaataaacgtactaatttaaatggtatcagcaagaaacagggaacncccctaagctctgatctatcgtacttacttcctagtttcgacgtaaagggttcgggggtaccctagtaaaggttcaaggttggactaggtggactcgtagggaactagtactttccacttctacactactccgcgtctcgactaaccgtagtaacgtactttacgactaacttactactagtacaacgtaacgtacttaccacgtcccgacccccgtatccgaccgttccgaccgaacggaccaacgaacgtaggaagtaacgttaaacgacgtgttcgcttacgaacacctaactcgtcttcttcgttaacttcccg

SEQ ID NO: 307725 - DNA, 605 bp, Homo sapiens
  misc_feature: GZ8MTXP01DA3K1.22.65.F10.1.454.CMB.2.raw
  modified_base (378)..(378): a, c, t, g, unknown or other
  misc_feature (378)..(378): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaaagtcagagcataaacgtatatttaaattggtatcagcaagaaaccaagggaaagcccctaaagctcctgatctatgctacttccagtttgcaaaaggtggggtcccgtcaaaggttcaagtggcagtggatcgtgggaacagattctactctcacactccncggtccgtcgacaactagtaagtacttacgtactaaacttaactaactacgtacaaacgaacgtaacttaaccgtacgtacccgaccccccgtaccgtaccgtaacccgttaccggtaccgaaacgggaaccgaacgtaacgtaaggaagtaaagttaaaacgtaaacgtacggttacggttcgttcgtaacaacctaacttacttcgttcttcgttaacgttcccg

SEQ ID NO: 307726 - DNA, 621 bp, Homo sapiens
  misc_feature: GZ8MTXP01C9VEA.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggcaagtcagagacaattaaacgtacttaatttaaattggtatcagacaagaaaccgaagggaaacgcccctaagctcctgatctatcgcttacttccagttttcgacgtaaaggtcgggggtccctagtaaggttcaaggtgggacaggtggattcgtagggaacagtactttaccactctaccacactcccgtcggtctcgactaaccgtagaaagtactttacgactaacttactatacgtacaaacgacgtaacttaaccgacgtcccgaccccccgtatacccgtacccgttccggaacccgaaacgggaccaacggtaaccgtacgggaaagtaaacgttaaaacgtaaacgtggttacggcgttacgaaccactaacttctacgttcttcgaacgtttccccg

SEQ ID NO: 307727 - DNA, 543 bp, Homo sapiens
  misc_feature: GZ8MTXP01BVTUU.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataaacgtactaatttaaattggtatcagcagaaaccagggaaagcccctaaagctcctgatctatgctacttccagtttgacaaaggtggggtcccgtcaaaggttcagtggcagtggatctgggaacagatttcactctcacatccgcgtctgcaacctgaaagtatttcgactaaacttactaactgttacaaacaagtaactttaacaacgttccgcccccccgatccacccttcgggacccaaaggggaccacggaactggagtaagttaaacgaaactgttaggcttgcacaactctgttcttcaattccc

SEQ ID NO: 307728 - DNA, 601 bp, Homo sapiens
  misc_feature: GZ8MTXP01DECG0.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaaggtcagagcaattaaacgtacttaatttaaattggtatcagacaagaaaccgaagggaaacgacccctaagctcctgatctatcgacttacttccagttttcgacgaaaggttcgggggtaccctagaaggttcaaggtggcgagttggatacgtgggaacagtactttcactctcacactccgcgtctgacaacctgaagtatttcgactaacttactaactagtacaaacgacgtactttaaccgacgttcccgaccccccgataccgtacccgttcggacccgaacgggaccaacggaacttacgggaagtaaacgttaaacgaaacgtgttcgggcttacggaaccaccgtaactctgttaccttcgaacgtttccccg

SEQ ID NO: 307729 - DNA, 613 bp, Homo sapiens
  misc_feature: GZ8MTXP01CNJ2P.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggcaagtcagagcaataacgtatatttaaatggtatcagacaagaaaccaagggaaacgcccctaagctcctagatctatcgcttacttcagtttgacaaaggtgggtcccctagaaggttcaagtggacaggtggaatcgtagggaacagtatttcactctacaccatccgtcgtctcgacaacctagaagtacttcgactaacttactactacgtacaacgaacgtacttaacgacgtcccgtccccccgatcccgtacccgttccggaaccgaaacgggaccaaccggtaacgtaacgggaaacgtaaacgttaaaaccgtaaacgttcggttacggttccttacggtaacccaaccgtaacgttcttacggttacctttaaccgttaacgtttccccg

SEQ ID NO: 307730 - DNA, 611 bp, Homo sapiens
  misc_feature: GZ8MTXP01D1I93.22.65.F10.1.454.CMB.2.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcacatcacctgccggnaagtcagagcaataaacgtacttatttaaattggtatcagcagaaaccagggaaacncccctaagctccngatctatgcttacttcctagtttgactaaaggtcggggtacccgtagaaggttcaggtggacaggtggatcgtagggaacagtatttacactctacacctactcccgcgtctcgacaacctagtaagtactttacgactaaacttactactagttacaaactaacgtacttaacacgttcccgaccccccgtatccgtaaccgttccggaccgaaacgggaccaacggtaaccgtagggaaagtaaacgttaaaaccgaaacgttggttcgggttcttcggaacctaacctaacttccgttcgttacctttccgttaacgtttcccccg

SEQ ID NO: 307731 - DNA, 593 bp, Homo sapiens
  misc_feature: GZ8MTXP01DAZF0.22.65.F10.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (345)..(345): a, c, t, g, unknown or other
  misc_feature (345)..(345): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagancataacgtatattaaatgtatcagacaagaaacaggaacgcccctaagctctgatctatgtacttacttcctagtttcgacgtaaagggttcggggtaccctagtaaaggttcaggtggnaggtcgatcgtgggaacagtatttcactctacacctacgtcccgcggtctacggaccaacctagaaacgttactttaccgacctaaacttactaactgtacaacgtagtaaccttacgacgtcccgaccccccgataccgtaccgttccggaccgaacgggaccaacggaacgtaggaaagtaaacgttaaacgaaacgtgttacggttcttcgaaccacctaattctcgttcttcttaacgttcccc

SEQ ID NO: 307732 - DNA, 531 bp, Homo sapiens
  misc_feature: GZ8MTXP01D1LF3.22.65.F10.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (325)..(325): a, c, t, g, unknown or other
  misc_feature (325)..(325): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccgggnaagtcagancataaacgtactatttaaattggtatcagcagaaaccagggaaacncccctaagctcctgatctatgcttacttccagtttgacaaaggttggggtaccctnaaaggttcagtggcagtggatcgtgggcagatttcactctcgacatcccgcgtctgcaacctagaagtatttacgacaacttactactatacaactacgtacttaacacgtcgcccccatccaaccttcgaccgaaaggaccacgaactggaagtaattaaacgaacgtgttaggcttagcaccaatctgttctcttaacttcccg

SEQ ID NO: 307733 - DNA, 539 bp, Homo sapiens
  misc_feature: GZ8MTXP01AL9EX.22.65.F10.1.454.CMB.2.raw
  modified_base (269)..(269): a, c, t, g, unknown or other
  misc_feature (269)..(269): n is a, c, g, or t
  modified_base (322)..(322): a, c, t, g, unknown or other
  misc_feature (322)..(322): n is a, c, g, or t
  modified_base (453)..(453): a, c, t, g, unknown or other
  misc_feature (453)..(453): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactattaaatggtatcagcaagaaaccagggaaacncccctaagctcctgatctatgctacttcagtttgactaaagtcggggtccctnaaggttcaggtggcaggtggatcgtgggaactagatttcactctcaacctatcccgcggtctgctaacctgaagtacttacgtaacttactactacgtacaaacaggtaacttacgacgtccgacccccgntccaccgttccggaccgtaaagggaccacgactggaagttataaacgacgtgtgacttgcctaacatctgtcttctcttcctcccg

SEQ ID NO: 307734 - DNA, 574 bp, Homo sapiens
  misc_feature: GZ8MTXP01D1UB9.22.65.F10.1.454.CMB.2.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataaacgtactatttaaatggtatcagcaagaaaccagggaaacncccctaaagctcctgatctatgcttacttccagtttgactaaaggtcggggtccctagaaggttcaggtggcagtgatcgtgggcagtatttcactctacaccatccgcggtctcgacaacctagaaagtatttacgactaacttactactagtacaacacgtaacttaacacgtccgaccccccatacctaccgttccggaccgaaacgggaccgaacgaaccgtaggaaacgtaaactttaaaacgaaacgttggttacgggcttacggccacctaacttctgttccttcttaactttccccg

SEQ ID NO: 307735 - DNA, 544 bp, Homo sapiens
  misc_feature: GZ8MTXP01DUJBD.22.65.F10.1.454.CMB.2.raw
  modified_base (216)..(216): a, c, t, g, unknown or other
  misc_feature (216)..(216): n is a, c, g, or t
  modified_base (265)..(265): a, c, t, g, unknown or other
  misc_feature (265)..(265): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaatgtatcagcagaaacagggaacncccctaagctctgatctatgctacttcctagtttgactaaaggtcgggggtccctagaaggttcagtggacaggtggatcgtagggctagtatttcactctcgacatccgcgtctgcaacctagaagtatttcgactaacttactactagtcaacgtactacttacacgtccgccccccgtatcctaaccgttcggaccgaaacggggacacggtaactagggagtaaacttaaacggaactgttggcttacgctaacctntcgtnttcttcttcttcc

SEQ ID NO: 307736 - DNA, 541 bp, Homo sapiens
  misc_feature: GZ8MTXP01DNF9L.22.65.F10.1.454.CMB.2.raw
  modified_base (380)..(380): a, c, t, g, unknown or other
  misc_feature (380)..(380): n is a, c, g, or t
  modified_base (524)..(524): a, c, t, g, unknown or other
  misc_feature (524)..(524): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggcaagtcagagcaataaacgtactatttaaatggtatcagacaagaaaccagggaaacgcccctaagctcctgatctatgctacttcctagtttgactaaaggtgggtccctgaaaggttcagtggctagtggatcgtgggaacagtatttcactctcacctatccgnggtctgacaacctgaaagtattcgactaacttactactgtacaacgagtacttacacgtccgcccccgatcctaccgttcggaccgaagggacacggaactggaagtaacttaaacgaaactgttacggcttgcactaatcgtnttcttcttaacgttccc

SEQ ID NO: 307737 - DNA, 563 bp, Homo sapiens
  misc_feature: GZ8MTXP01AMC25.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatgtatcagcagaaacagggaaacgcccctaagctcctgatctatgctacttccagtttgactaaaggtcgggggtcccgtacgaaaggtttcaaggtggcagtggatcgtgggaacagtatttcactctcaccatccgcggtctcgacaacctgaagtattcgactaacttactactagtacaaacacgtaccttaacgacgttacccgcccccccgtatcctacccgttccgggaccgaacgggaccacggaaccgtgggaagtaaacgttaaacgaacgtgttacggcttcgccacctcttctcgttcttcgttcgtcc

SEQ ID NO: 307738 - DNA, 547 bp, Homo sapiens
  misc_feature: GZ8MTXP01AGPS5.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactatttaaatggtatcagcagaaaccagggaaacgcccctaaagctcctgatctatgctacttccagtttgactaaaggtgggggtacccctgaaaggtttcagtggcaggtggatcgtgggcagtatttcactctcacatccgcgtctgcaaccgtgaagtatttcgactaacttactactgttacaacagtacttacacgtccgcccccgatccgtacccgttcggcccgaaaggggaccaacgaaccgtaggaacgtaacttaaacgaacttggttcggcttcgcaccctaatctgttctcgaacttcccg

SEQ ID NO: 307739 - DNA, 590 bp, Homo sapiens
  misc_feature: GZ8MTXP01CJ11S.22.65.F10.1.454.CMB.2.raw
  modified_base (215)..(215): a, c, t, g, unknown or other
  misc_feature (215)..(215): n is a, c, g, or t
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtaggagacagatcacatcacctggccggnaagtcagagcaataaacgtacttaatttaaatggtatcagacaagaaaccgaagggaaacncccctaagcctcctagatctatcgtcttacttctagtttcgacgtaaagggtcggggtaccctagaaggttcaggtggctaggtgatcgagggctagtactttcactctcacctntccgcgtctgacaactagaacgtactttacgactaacttactactacgtacaaacgtacgtaacttaccgacgtccccgaccccctatccgtacccgttcggaccgaaacgggaccacggtaacgtaggaagtaaacgttaaacgaacgtggttacggcttacgaacctactaatctgttccttcgttaacgttccccg

SEQ ID NO: 307740 - DNA, 575 bp, Homo sapiens
  misc_feature: GZ8MTXP01EEWLZ.22.65.F10.1.454.CMB.2.raw
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactatttaaatggtatcagcaagaaaccagggaaacncccctaagctctgatctatgcttacttcctagtttcgactaaaggtcgggggttacccctagaaaggttcaggtggacaggtggatcgtagggaactagtactttcacttctacacctactccgcggtctgactaaccgtagaagtactttcactaacttactactacgtacaactacgtacttacacgtccgcccccgatccaccgttcggaccgaaacgggaccacggaacgttaggaacgtaaacgtttaaacgaaacgtgttacggcttcgaacacctaatctcgttcttcaacgtttccc

SEQ ID NO: 307741 - DNA, 568 bp, Homo sapiens
  misc_feature: GZ8MTXP01AZTDH.22.65.F10.1.454.CMB.2.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (440)..(440): a, c, t, g, unknown or other
  misc_feature (440)..(440): n is a, c, g, or t
  modified_base (551)..(551): a, c, t, g, unknown or other
  misc_feature (551)..(551): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagancataacgtactattaaatgtatcagcagaaaccagggaaacgcccctaaagctctgatctatgctacttcagtttagacgtaaaggtcgggtacctgaaacggtttcaagttggactaggttggactcgtagggaactaggtactttacacttcacaacctactcccgcggtctcgacaacgttcgaaagtactttacgactaaacttactaactntacaactacgtaacttacacgtccgaccccccgatccaccttccgaccgaaggaccacgaactagggttagaacgttaaacgaacgttgacggcttacgcactaactcgtnttcttcttaacgttccc

SEQ ID NO: 307742 - DNA, 591 bp, Homo sapiens
  misc_feature: GZ8MTXP01DMH5T.22.65.F10.1.454.CMB.2.raw
  modified_base (214)..(214): a, c, t, g, unknown or other
  misc_feature (214)..(214): n is a, c, g, or t
  modified_base (272)..(272): a, c, t, g, unknown or other
  misc_feature (272)..(272): n is a, c, g, or t
  modified_base (573)..(573): a, c, t, g, unknown or other
  misc_feature (573)..(573): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggnaagtcagagcaataaacgtacttatttaaattggtatcagcaagaaaccagggaaacncccctaagctcctgatctatgcttacttcctagtttgactaaaggtcgggggtaccctagaaaggttcaggtggacgtagtggtatcgtagggaacagtacttcactcctacaccgtactccgtcggtctacgactaaccgtagaacgttactttccgaacttaaaccttactactacgtaaccaaacggtactaacttaccacgttccccgacccccgtataccaccgttcggacgaacggacacgtaagtaggaagtaaacttaaacgtaactggttacggcttcaactacctaattcncgttctcttaacttcccc

SEQ ID NO: 307743 - DNA, 568 bp, Homo sapiens
  misc_feature: GZ8MTXP01CVRDG.22.65.F10.1.454.CMB.2.raw
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (324)..(324): a, c, t, g, unknown or other
  misc_feature (324)..(324): n is a, c, g, or t
tcagacatacgcgtcacgaccggtgctcgatttagctacgctctaagggggagtcagtctcagtcaggacacagcatggacatgagggtccccgctcagctcctgtggctcctgctactctggctccgaggtgccagatgtgacatccagatgacccagtctccatcctcctgtctgcatctgtaggagacagagtcacatcacctgccggcaagtcagancaataacgtactatttaaatgtatcagacaagaaaccagggaaacncccctaagctcctgatctatgctacttccagtttgacgtaaaggtcggggtaccctntaaggttccaggtggcagtggaatcgtgggactagtatttcactctacaccatccgcggtctgacaactagaagtactttcgactaaacttactactacgtacaacacgtaccttaacacgtcccgacccccgatcccgaccgttccggaccgaaacgggccaacggaacttagggaaacgaagttaaaaccgacgttacggttcggacttcgacctaacctactcttcgttccgttctaaccc

SEQ ID NO: 307744 - DNA, 547 bp, Homo sapiens
  misc_feature: GZ8MTXP01DX6PB.22.65.F10.1.454.CMB.2.raw
  modified_base (224)..(224): a, c, t, g, unknown or other
  misc_feature (224)..(224): n is a, c, g, or t
  modified_base (267)..(267): a, c, t, g, unknown or other
  misc_feature (267)..(267): n is a, c, g, or t
  modified_base (456)..(456): a, c, t, g, unknown or other
  misc_feature (456)..(456): n is a, c, g, or t
  modified_base (491)..(491): a, c, t, g, unknown or other
  misc_feature (491)..(491): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctggccggcaagtcagancaataacgtatattaaatgtatcagcaagaaaccaagggaacncccctaagctctgatctatgcttacttctagtttgactaaagggtcgggggtaccctagaaaggttcaggtggcagtgggatcgtagggcagtatttcactctcactactccgcgtctgacaacctagaagtactttacgactaaacttactactagtacaactaagtacttaacacgtccgacccccntacctaccgtcggacaacggacacgaactaggaanaagttaaacgaagtgttcggcttcgaactaccaattctcgttcttaacttcttccc

SEQ ID NO: 307745 - DNA, 587 bp, Homo sapiens
  misc_feature: GZ8MTXP01EU98N.22.65.F10.1.454.CMB.2.raw
  modified_base (276)..(276): a, c, t, g, unknown or other
  misc_feature (276)..(276): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagcaataaacgtactaatttaaattggtatcagacaagaaaccgagggaaacncccctaagcctcctagatctatgctacttcctagtttcgactaaagggtcggggtccctagaaaggttcaggtggcaggtggatcgtagggaactagtatttcactctcacatccgcgtctgcactagaagtacttacgactaacttactactagtacaactacgtaacttacacgtcccgaccccccgtataccctacccgttccggacccgaaacgggaccacggaacgtaggaagtaacgttaaaacggaacgtggttacgggcttcggaacacctaattctacggttccttccgttaacgtttcccc

SEQ ID NO: 307746 - DNA, 532 bp, Homo sapiens
  misc_feature: GZ8MTXP01BZL0J.22.65.F10.1.454.CMB.2.raw
  modified_base (322)..(322): a, c, t, g, unknown or other
  misc_feature (322)..(322): n is a, c, g, or t
  modified_base (485)..(485): a, c, t, g, unknown or other
  misc_feature (485)..(485): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataaacgtatatttaaattggtatcagcagaaaccagggaaacgcccctaagctcctgatctatgctacttccagtttgcaaaggtggggtccctnaaaggttcagtggcagtggatcgtgggaacagtatttcactctcaccatccgcggtctgcaacctgaaagtatttacgactaacttactactgtacaaacgagtaacttacacgtccgccccccgatccaccgttcggaccaaagggaccacgaactgggaanaattaaacgaactggttagcttgccacaatctgttcttcaacttccc

SEQ ID NO: 307747 - DNA, 657 bp, Homo sapiens
  misc_feature: GZ8MTXP01DNYUJ.22.65.F10.1.454.CMB.2.raw
  modified_base (214)..(214): a, c, t, g, unknown or other
  misc_feature (214)..(214): n is a, c, g, or t
  modified_base (411)..(411): a, c, t, g, unknown or other
  misc_feature (411)..(411): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactatttaaatggtatcagcaagaaaccaagggaaagaccccctaagctcctgatctaatcgcttacttccagtttgactaaaaggtcgggggtacccgtacgaaaggtttcaaggttggctaggtggatccgtggggaacagtatttcactctcacatccgcgtctgacaacctgaaanacttttcgactaaactttactaactacgtacaaactacgtaacctttaaccacggttacccgccccccccgtaataccccgtaacccgtttaccgggacccgaaacgggggacccaaaccgggaacccgttagggaaacggtaaacttaaaaaccggtaaaccgttgggttaacgggcctttacggaacctaaccccgtaaagtttccgttacgttcctttaacccgttaaacgtttttccccccg

SEQ ID NO: 307748 - DNA, 541 bp, Homo sapiens
  misc_feature: GZ8MTXP01DNNWL.22.65.F10.1.454.CMB.2.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (384)..(384): a, c, t, g, unknown or other
  misc_feature (384)..(384): n is a, c, g, or t
tcagacatacgcgtcacgaccggtgctcgatttagctacgctctaagggggagtcagtctcagtcaggacacagcatggacatgagggtccccgctcagctcctgtggctcctgctactctggctccgaggtgccagatgtgacatccagatgacccagtctccatccctccctgtctgcatctggtagganacagatcaccatcacctgccggnaagtcgancataacgtatattaatgatcagcagaaacaggaacncccctaagctccngatctatgctacttcagtttgacgtaaggtcgggtccctgaaggttcagtggctagtggatcgtgggaacagtatttcactctacacatccgcgtctgacaacgtgaaagtntttacgactaacttactactagtacaacgacgtacttacacgtccgcccccgtatcctaccgttcggaccgaagggaccacgaacgtggaagtaacgttaaacgaacgtggacggttcgttacgctaccaacttctcgttcttcgttaacgttcccg

SEQ ID NO: 307749 - DNA, 626 bp, Homo sapiens
  misc_feature: GZ8MTXP01DO4TY.22.65.F10.1.454.CMB.2.raw
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccactcctccctgtctgcatctgagagacagatcacatcactgccgganaagcaganacaataacgttattaatttaaatgtancanacaagaaacgagggaaccncccctaagcctcctagacttctatcgtacttacttcgtagtttcgaacgtaagggttcgggtaccctagaacggttcgacgtggactaggtgtaactcggtaggaacattactttacactctacgacctgtccgtgtctacgactaacgtagtaagtacttactactaacttaactacttactaaaccaacggttactaacctttaaccgacccgttacccggaccccctatacccgtaacccggttccggaaccgaaacgggtacccaaggtaaccgttagggaaacttaaagttaaaccgacgttagcggttacttccgaactaccttcgttcctcgttacctaacttccttcccg

SEQ ID NO: 307750 - DNA, 555 bp, Homo sapiens
  misc_feature: GZ8MTXP01A8X2A.22.65.F10.1.454.CMB.2.raw
  modified_base (325)..(325): a, c, t, g, unknown or other
  misc_feature (325)..(325): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataaacgtactatttaaattggtatcagacagaaaccagggaaacgcccctaagctcctgatctatgctacttccagtttgacaaaggtggggtcccgtnaaaggttcagtggcaggtggatcgtggggaacagtactttcactctacaccatccgcggtctgacaacctgaacgtatttacgactaacttactaactgtaccaacagtaccttaacgacgtccgccccccgatccaccgttccggaccgaacgggacacgaacgtaggagaacgttaaacgaacgtgttacggcttggaaccacctaatcgtcttcttcgaacttcccc

SEQ ID NO: 307751 - DNA, 707 bp, Homo sapiens
  misc_feature: GZ8MTXP01CO97U.22.65.F10.1.454.CMB.2.raw
  modified_base (214)..(214): a, c, t, g, unknown or other
  misc_feature (214)..(214): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcaataacgtactatttaaattggtatcagcagaaaccgagggaaacgcccctaagctcctgatctatgtcttacttccgtagtttgacgtaaaggtcggggtaccccgtagtaaggttcaggttgggactaggtggatccgtaggggaactagtacttttccgacttccgtccaacctacgtcccggtcggttccgtacggtaccctaaaccgttaggaaacgttacgttttccgaccttaaacctttaccttaacgttacgtaccaaacgtacgtaaccttaaccgtaccggtcccgaccccccccgtacttacccctacccgttacccgggacccgaaacggggtaacccgaaccggtaacgtaacggggaaacggtaaacgttaaaaccggtaaaccgttcgggttacgggttccgttacggaaccctaacccgtaacgttcccttacggtttaccttaaccgttaaccgtttaacccccg

SEQ ID NO: 307752 - DNA, 594 bp, Homo sapiens
  misc_feature: GZ8MTXP01CCKLQ.22.65.F10.1.454.CMB.2.raw
  modified_base (215)..(215): a, c, t, g, unknown or other
  misc_feature (215)..(215): n is a, c, g, or t
  modified_base (585)..(585): a, c, t, g, unknown or other
  misc_feature (585)..(585): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggganaagtcagagcaattaaacgtacttaatttaaattggtatcagacaagaaaccgaagggaaacgcccctaaagctcctgatctatgcttacttcctagtttgacgtaaaggtcgggtaccctagaaggttcaggtggacaggtggatcgtagggaactagtactttcactctacacctactccgcggtctgactaacctagaagtactttcgactaaacttactactcgtacaacgtagtaacctttacacgtacccgccccccgtattcccgtaaccgttccggacccgaaacgggaccaaccggtaacgtaggaacgtaaacgttaaacgtaaaccgtgttacggcttacgccactctctcttccttcnctttccccg

SEQ ID NO: 307753 - DNA, 561 bp, Homo sapiens
  misc_feature: GZ8MTXP01CHZU1.22.65.F10.1.454.CMB.2.raw
  modified_base (215)..(215): a, c, t, g, unknown or other
  misc_feature (215)..(215): n is a, c, g, or t
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaatgtatcagcagaaaccagggaacncccctaagctcctgatctatgctacttccagtttgacaaggttcgggggtccctagaaggttcaggtggcaggtggatcgtagggcagtatttcactctcaccagtccgcgtctgacaacctgaagtacttcgactaacttactactgtacaacgtagtaacttacacgtcccgaccccccgtatccctaccgttccggacccgaacggggaccacggaactgggaacgtaaacttaaaccgaaacgttggttacggcttcggccaccctaattctcgttccttcgaacttccccg

SEQ ID NO: 307754 - DNA, 695 bp, Homo sapiens
  misc_feature: GZ8MTXP01D3I77.22.65.F10.1.454.CMB.2.raw
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (263)..(263): a, c, t, g, unknown or other
  misc_feature (263)..(263): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctcatcctcctgtctgcatctgtagganacagagtcacatcactgccggnaagtcagancaataacgtatattaaatgtatcagcaagaaaccgaggaaacnccctaagctctagatctatcgacttacttacctaggtttacgacgtaaagggttcgggggtaccccttagaaacggtttcaacgggttcgggactaagggttacgggaacttcccggtagggggtaacctaagggttaactttttaccgaacccgtttcctaccctaacccgtaacgttcccggtacgggttccttacggacctaaccgttaggtaaacgttacgttttaccgactaaactttaactaacgttagttaaccaacggtaacggtaacctttaaccgacgttacccgaccccccgtatcccgtacccgttacgaccgtaaacgggaccgaacggtaacgtagggaacgtaaacgttaaacgtaaacgtggcggttcaccggtaactaccctaattcggtcgttacttaacttaaccgtttcccg

SEQ ID NO: 307755 - DNA, 597 bp, Homo sapiens
  misc_feature: GZ8MTXP01CRH7F.22.65.F10.1.454.CMB.2.raw
  modified_base (215)..(215): a, c, t, g, unknown or other
  misc_feature (215)..(215): n is a, c, g, or t
  modified_base (571)..(571): a, c, t, g, unknown or other
  misc_feature (571)..(571): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtactaatttaaattggtatcagacaagaaaccaagggaaacgacccctaagctctgatctatgcttacttcctagtttgacgtaaaggttcgggggtacccgtacgtaaaggttcgaaggttggacgtaggtggattcgtagggaacagtatttcacttctacactactccgcggtctcgacaacctgaagtactttcgactaacttactactacgtacaacgtacgtactttacacgtacccgccccccgactccgtacccgttccggaccgaaacgggaccaaccggaacgtacggaagtaaacttaaacgaaacgtgttacggcttagccaccgtntcgttcgttaccttcttaacttcccg

SEQ ID NO: 307756 - DNA, 637 bp, Homo sapiens
  misc_feature: GZ8MTXP01ECU8Q.22.65.F10.1.454.CMB.2.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctggccggcaagtcaganacaataaacgtacttaatttaaatggtatcagacaagaaaccgaagggaaacncccctaagcctcctagatctatcgtcttacttctagtttcgacgtaagggtcggggtaccctagtaaggttcaggtggcgtagtggtatcggtagggaactagttactttcgaacttctaccaccgtactcccgtcggtctcgacctaaccgtagtaaacgttacttacgacctaaacttactaactacgtaccaaactaacgtaaccttaaccgaccgttacccgacccccgtacttacccgtaaccgtttcgggaaccgaacgggtaccgaacggtaacgtagggaaacgtaaacgttaaacgtaaacgtgttcggcgttcgaactactaacttctcgttcttaacttaacgtttcccc

SEQ ID NO: 307757 - DNA, 690 bp, Homo sapiens
  misc_feature: GZ8MTXP01CN3EK.22.65.F10.1.454.CMB.2.raw
  modified_base (219)..(219): a, c, t, g, unknown or other
  misc_feature (219)..(219): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaacatccaccgtggccgganaagtcagagactaattaaacgttattaatttaaagtggtaactcgagacaaacgaaaccgaaagggaaaccgtaccccctaagtcctacctagacttactagtcgtaccttaacttccgtaagtttcgaacgtaaacggggttccgggggtacccctagtaaacgggttcctaaggggtggacgtagggtaggtacttaccgggtaggggaacctaagttcttttaccaccttcctacaccctagtcccgtcgtctacgacctaaccgtagtaagttacttacgactaacttactactacgtacaacggtactaacgtaccgacgtccccgacccccgtactacccgtaacccgttcgaaccgtaacggaaccgacgaacggtaggaaacgtaaacgttaaacgtaaaccgtggttacgttcgttacgaacctacctaacttcgtacgttccttccgttaacgtttccccg

SEQ ID NO: 307758 - DNA, 569 bp, Homo sapiens
  misc_feature: GZ8MTXP01BXEG2.22.65.F10.1.454.CMB.2.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggnaagtcagancaataacgtattaattaaatggtatcagcaagaaaccgagggaaacncccctaagctcctgatctatcgacttacttccgtagtttcgacgtaaagggttcggggtaccccgtagtaaagggttcaggtgggcaggtggatcgtagggaacagtactttcactctacacctatccgcgtctcgacaacctagaagtcttacgactaacttactactagtacaacacgtacttaaccacgtcccgacccccgatcctaccgttccgaccgaaggaccacggtaacgtaggaataacgttaaacgactggttcgcttcgaaccactaatctcgttcttcaacgttcccg

SEQ ID NO: 307759 - DNA, 661 bp, Homo sapiens
  misc_feature: GZ8MTXP01D0BMF.22.65.F10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgccggnaagtcagancattaaacgtatatttaaatggtatcagcaagaaaccgaagggaaacncccctaagcctctagatctatcgtcttaacttccgtagtttcgaacgtaaagggtcgggggttacccctagtaaaggttcaggtggactaggtggacttcgagggaactagtactttaccactcctacacctatcccgtcggtctcgacctaaccgtagtaaacgttacgtttaccgaaccttaaacttaacctaacttacgtaacctaaacgtaacgttaaccttaaccgaccggttaccccgacccccccgtatacccgtaacccgttaccggaaccggaaacggaaccgaaccggaacgtagggaaacgtaaacgtttaaacgaaacgttggttcgttcgttacgcctaaacgtcgttcctacgttcctttaacgaaccgtttccccg

SEQ ID NO: 307760 - DNA, 624 bp, Homo sapiens
  misc_feature: GZ8MTXP01BEEPU.22.65.F10.1.454.CMB.2.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggnaagtcagagcaataaacgtacttaatttaaattggtatcagacaagaaaccagggaaacncccctaaagctcctgatctatgctacttccagtttgacaaaggtcggggtcccctagaaaggtttcaggtggcaggtggatcgtagggcagtatttcactctacacactccgcggtctcgacctaacctgaaagtactttacgacctaaacttacctaactcgtaaccaactaacgtaaccttacaaccgtccgacccccccgtatcccgtaacccgttccggacccgaaacgggaccaacggtaacgtagggttaaacgtaaacgtttaaaacggaaccgttaggttcgggccttacggaaccctaaccctaattccgttacgttcctttccgttaacgtttcccccg

SEQ ID NO: 307761 - DNA, 646 bp, Homo sapiens
  misc_feature: GZ8MTXP01CPVK5.22.65.F10.1.454.CMB.2.raw
  modified_base (297)..(297): a, c, t, g, unknown or other
  misc_feature (297)..(297): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatcgtgtaggagacagagtccaccatccaccgtcggccgggacaagtcagagactaattaaaccgttattaatttaaagttggtaatcgaagacaaacggaaaaccgaagggaaaccncccctaaagccttcctagactctatcgtaccttacttccgtagtttcgaacgtaagggtccgggggtaccctagtaaggttcaggtcggactaggtggactcggtagggaactagttactttccactccacaactcgtccgtcgtcgtcgacctaaccgtagaaacgttacttaccgacttaaacttactaactacgtaaccaaacgtacgtaaccgttacgaccggtaccccgacccccgtatacccgtaccgttaccggaaccgaaacgggaccacggtaacgtaaggaacgtaaacttaaacgacgtggacggcttacgcactaactctcgttcttcgctttcccg

SEQ ID NO: 307762 - DNA, 543 bp, Homo sapiens
  misc_feature: GZ8MTXP01E15XS.22.65.F10.1.454.CMB.2.raw
  modified_base (455)..(455): a, c, t, g, unknown or other
  misc_feature (455)..(455): n is a, c, g, or t
  modified_base (530)..(530): a, c, t, g, unknown or other
  misc_feature (530)..(530): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccagggaaacgcccctaagctcctgatctatgcttacttccagtttgcaaagtcgggggtcccgtcaaggttcaggtggcagtggatcgtgggaacagtatttcactctcaccatcccgcggtctggcaaccctgaaagtagtttcactaaacttactaactgtaccaacagtacttaccacgtccgccccccccgtancctacccttccgggacccgaaacgggaccacgaacctggaagaacttaaacgaactgttggcttcgcacaatctnttcttcaattccc

SEQ ID NO: 307763 - DNA, 619 bp, Homo sapiens
  misc_feature: GZ8MTXP01A66CX.22.65.F10.1.454.CMB.2.raw
  modified_base (273)..(273): a, c, t, g, unknown or other
  misc_feature (273)..(273): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataaacgtactaatttaaattggtatcagcaagaaaccagggaaacncccctaagctcctgatctatgacttacttcctagtttcgacgtaaaggtcggggtccctagaaggttcaggtggcagtggatcgtagggaacagtactttcactctaccacctactcccggcggttctcggacctaaacccgttggaaacgtacgttttaccgactaaaccttactaactacgttaccaaacgaacgtaccttaacacgtacccggtaccccccattcctaacccggtttccggacccgaaacgggaccgaacgtaacgtacgggttaaagtaaacgttaaaccgtaacgtgttacggcttcgaaccactaactcgtgttccttcgaacttccccg

SEQ ID NO: 307764 - DNA, 630 bp, Homo sapiens
  misc_feature: GZ8MTXP01ARNVX.22.65.F10.1.454.CMB.2.raw
  modified_base (273)..(273): a, c, t, g, unknown or other
  misc_feature (273)..(273): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaccgtgccgggcaagtcagagcaataacgtactaatttaaattggtatcagcaagaaaccagggaaacncccctaagctcctgatctatgcttacttccagtttgacgtaaacggtcgggggttacccgtacgaaagggtttccaaggttgggcgaggtggtaatcgtgggggaactaacggtacttttcaacctctaccaacctacgtcccggtcggtcttcggaccaaacccgtagaaaggtacttttacggacctaaacttacctaactacgttacaaacgagtaacctttacgaacggttcccgccccccgatcccgtaccgttccggacccaaacggggaccaacggtaacgtacggaaacgtaaacgttaaacgaaacgtgttacggcttcgaacactaatctcgttctcaacttccccg

SEQ ID NO: 307765 - DNA, 531 bp, Homo sapiens
  misc_feature: GZ8MTXP01DHFMS.22.65.F10.1.454.CMB.2.raw
  modified_base (213)..(213): a, c, t, g, unknown or other
  misc_feature (213)..(213): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggnaagtcagagcataaacgtactatttaaattggtatcagcagaaaccagggaaagcccctaaagctcctgatctatgctacttccagtttgcaaagtggggtccctgaaggttcagtggcagtggatcgtgggcagatttcactctcaccatccgcgtctgcaacctgaaagtatttcgactaacttactactagtacaacgacgtacttacacgtccgccccccgatcctaccgttcgccaagggacacgaactggaagaacttaaacgaacgtgttacggcttacgcaacctaatctgttccttcttaacttccccg

SEQ ID NO: 307766 - DNA, 549 bp, Homo sapiens
  misc_feature: GZ8MTXP01DU8S4.22.65.F10.1.454.CMB.2.raw
  modified_base (214)..(214): a, c, t, g, unknown or other
  misc_feature (214)..(214): n is a, c, g, or t
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccggnaagtcagagcataaacgtactattaaattggtatcagacagaaaccaagggaaacgcccctaagctccngatctatgctaacttcagtttgcaaaggtggggtccctnaaggttcagtggcattgggatcgtggggaactagtacttttcacttctacacctactcccgcggtctcgcctaacctgtaaagtatttcgactaacttactactcgtacaacacgtacttacacgtccgccccccgtatcctaccgttccggaccgaaggaccacgaactggagtaaacttaaacgaactgacggcttcgctacaacttcgtcttcttcaacttccc

SEQ ID NO: 307767 - DNA, 548 bp, Homo sapiens
  misc_feature: GZ8MTXP01AD4M3.22.65.F10.1.454.CMB.2.raw
  modified_base (515)..(515): a, c, t, g, unknown or other
  misc_feature (515)..(515): n is a, c, g, or t
  modified_base (541)..(541): a, c, t, g, unknown or other
  misc_feature (541)..(541): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactatttaaattggtatcagcagaaaccagggaaacgcccctaagctcctgactctatgctacttccagtttgactaaaggtcggggtcccgtcgaaaggtttcagtggacaggtggatcgtgggaacagtactttcactctcaccactccgcggtctgacaacctgaagtatttcgactaacttactactgtacaaagacgtaacttacacgtccgcccccgtactccaacccgttcggacccgtaaagggaccacgaacgtggaataacttaaacgacgtgnggcttggccactaactcgtattctcncttcccg

SEQ ID NO: 307768 - DNA, 609 bp, Homo sapiens
  misc_feature: GZ8MTXP01EWXSO.22.65.F10.1.454.CMB.2.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccgggnaaagtcagagcataacgtatattaatggtatnagcaagaaaccagggaaacncccctaagcctcctgatctatcgtcttacttctagtttcgacgtaaaggtcgggggtacccgtagtaaaggttcaggtggacaggtgactcgtagggaactaggtactttacactcctacacctactcccgtcggtctcgacaaccgtagtaaacgtactttaccgactaaacttacctaactacgtacaaacgacgtaacttacgacgtcccgaccccccgtactaccgtacccgttaccggaccgaaacgggaccgaacggaacgtaggttaacgtaaacgttaaacgaacgtggttcggcttacgaacacctaatctcgttcttcgttaacgttccccg

SEQ ID NO: 307769 - DNA, 628 bp, Homo sapiens
  misc_feature: GZ8MTXP01BAPFK.22.65.F10.1.454.CMB.2.raw
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaccgtgccgggnaaagtcagagcaattaaacgtattatttaaatggtatcagacaagaaaccgagggaacncccctaagctcctgatctatcgcttacttccgtagtttcgacgtaaaggttcgggggtccctagtaaacgggttcaggtggactaaggtcggatacgtaggggaactaggtacttttccacttctacacctacgtcccgtcggtctacgactaaccgtagtaaacgtacgtttccgactaaacttactacttacgtaaccaacgaacggtaaccttaccaccgttcccgacccccccgtatacccgtaccgttccggaccgaaacgggaccaacggaacgtacggaagtaaacgttaaacgaaccgtggacgttcttcgaacaccgtaatctcgttacttcgttaacttcccg

SEQ ID NO: 307770 - DNA, 645 bp, Homo sapiens
  misc_feature: GZ8MTXP01D6MZP.22.65.F10.1.454.CMB.2.raw
  modified_base (213)..(213): a, c, t, g, unknown or other
  misc_feature (213)..(213): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggnaagtcagagacaataaacgtattaatttaaagtggtatcagacaagtaaaccgaaggggaaaccnccccctaaagcctcctagtacttctatcgtccttaacgttcctaggtttcgaacgtaaagggttcgggggtaccctagtaacggttcgaggtcggactaggtcggtaactcgggtagggaactagttactttacccacctctaccacctacgtcccgtcggtctacgacctaaccgtaggtaaacttcttacgacctaacttactactactaacaaacggtactaaccttaacaccgtccccgccccccgtatcccgtaaccgtccggaaccgaaacggacctaacgaacgttaaggaagtaaacgttaaacgaacgttggacggcgttacgcctaactcttctcgttcttaaccgttctttccccg

SEQ ID NO: 307771 - DNA, 630 bp, Homo sapiens
  misc_feature: GZ8MTXP01AF3N2.22.65.F10.1.454.CMB.2.raw
  modified_base (282)..(282): a, c, t, g, unknown or other
  misc_feature (282)..(282): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtccaccatcaccgtggccgggacaagtcagagacataacgtacttaatttaaatggatcgagacaacgaaaccgagggaaaccncccctaagtcctacctagacttctaatcgtaccttacgttcctagtttcgacgtaaacgggtcgggtccctagtaaggttcaggtggactaggtcgatcgtagggaactagtactttcacgtctaccgactacgtccgcgtctcgactaccgtagacgtacttcgactaacttactactacgtaacaacgtagtaccttacgaccgttaccccgacccccgtagtcccgtaaccgttccggaccgaacggtaaccaaccggtaacgtacgggttaaactaaacgttaaacggacgttcggttacgcgttacgcctataacttcgttacttcttaaccgaactttcccg

SEQ ID NO: 307772 - DNA, 531 bp, Homo sapiens
  misc_feature: GZ8MTXP01D02ZY.22.65.F10.1.454.CMB.2.raw
  modified_base (269)..(269): a, c, t, g, unknown or other
  misc_feature (269)..(269): n is a, c, g, or t
  modified_base (515)..(515): a, c, t, g, unknown or other
  misc_feature (515)..(515): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataaacgtactattaaattggtatcagcagaaaccagggaaancccctaagctctgatctatgctacttccagtttgacaaaggtcggggtccctgaaggttcagtggcagtggatcgtgggaacagtatttcactctcaccatccgcgtctgcaacctgaagtattacgactaacttactactagtacaaacacgtaacttacacgtccgccccccgatccaccttcggaccaagggacacgaactaggagtaacttaaacgaaactgttaggcttcgcactaatctnttcttcttaacttccc

SEQ ID NO: 307773 - DNA, 649 bp, Homo sapiens
  misc_feature: GZ8MTXP01BSUY7.22.65.F10.1.454.CMB.2.raw
  modified_base (215)..(215): a, c, t, g, unknown or other
  misc_feature (215)..(215): n is a, c, g, or t
  modified_base (621)..(621): a, c, t, g, unknown or other
  misc_feature (621)..(621): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtacttaatttaaattggtatcagacaagaaaccagggaaacgcccctaaagcctcctagatctatcgcttacttcctagtttgacgtaaaggtcgggggtaccctgtaaaggttcaaggtggacaggtggattcgtagggaacagtacttttacacttcctacaccctagtcccggtcggtccttcgaccgtaaaccctggtaaacgtacgttttaccgacctaaactttacctaacttagttaccaaacgtacgtaacctttaacgacgttacccgcccccccgtatacccgtacccgttaccggacccgaaacggggaccaaccggtaacgtacgggaaacgtaaacgttaaaacgaaccgtggttacggttcttacgaaccaactnttcctcgttacttccttaacgtttcccg

SEQ ID NO: 307774 - DNA, 614 bp, Homo sapiens
  misc_feature: GZ8MTXP01ENYND.22.65.F10.1.454.CMB.2.raw
  modified_base (599)..(599): a, c, t, g, unknown or other
  misc_feature (599)..(599): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggacaagtcagagactaataaacgtacttaatttaaattggtatcagacaagaaaccaagggaaacgcccctaaagcctacctgatctatcgccttaacttcctaggtttcgactaaagggttcgggggtaccccttagaaagggtttcaaggttcgggacgtaggtaggattacgtaggggaactagtatttcactctacaccatcccgcggtctcgactaacctgaaagtactttacactaaacttactactagtacaaacgacgtacttaaccacgtcccgaccccccgataccgtacccgttcggaccgaaacgggaccaacgaacgtacggaagtaaacttaaacgaaactggttacggcttacgaaccactaactccttnttccttcttctcccg

SEQ ID NO: 307775 - DNA, 624 bp, Homo sapiens
  misc_feature: GZ8MTXP01CXLBH.22.65.F10.1.454.CMB.2.raw
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccacttccctccctgtctgcatctgtaaggagacagacgtccacatccaccgtggccggganaagtcagagactaattaaacgtacttaatttaaatggtatcagacaagaaaccgagggaaacncccctaagcctctagatctatcgacttactctagtttgacgtaagggtcggtaccctagaagtcagtggacngtgactcgtagggaactagttacttaccactcctaccaacgtcgtccgtcggtaccttacggactaaccgtaagaacgtttacgttaccgtaactttaaacctacttaacgtacgtaaccaacggtaaacgtaccttaaccgtaccggtaccccgacccccgtatacccgtaaccgttccggaccgaaggacctaaggaaccgtagaacgtaaacgttaacgaacttggacgttnaccnctacctntctcgttctcgttctcc

SEQ ID NO: 307776 - DNA, 595 bp, Homo sapiens
  misc_feature: GZ8MTXP01BKFDZ.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancaattaacgtactaatttaaattggtatcagcaagaaaccgaagggaaacnccccctaaagcctcctgatctatcgtcttactttccagtttacgcgtaaaggtcgggggttaccccgtagaaggttcaggttgggctagggtggatcgtggggaactagtactttcacttctacacctatccgtcggtctacggtaacctagtaagtatttcgtactaaacttactactgtacaaacgacggtaacttacacgtacccgacccccgactcctaccgttccggaccgtaagggaccacgactaagggaacgaacgttaaacgaacgttgtacggcttcgcctaacatctacgtcttcaacttccttaacccg

SEQ ID NO: 307777 - DNA, 591 bp, Homo sapiens
  misc_feature: GZ8MTXP01AO4UR.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcaattaaacgtactaatttaaattggtatcagcaagaaaccagggaaacgcccctaagctcctgatctatgctacttccagtttgactaaaggtcggggtaccctagaaaggtttcaggtggcaggtggatcgtgggaacagtatttcactctacacctatccgcgtctcgactaaccgtgaagtacttcgactaacttactacttcgtacaaacgacgtaaccttacacgtcccgaccccccgtatacctacccgttccggaccgaacgggaccaacggaacgtacgggaagtaaacgttaaacgaacgtggttcggttcttacgaacctacgtaacttctacgttccttccgttaacgtttccccg

SEQ ID NO: 307778 - DNA, 685 bp, Homo sapiens
  misc_feature: GZ8MTXP01C606E.22.65.F10.1.454.CMB.2.raw
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccactccctcctgtctgcatcgtagtaggagacagagtccacactccaccgtggccggacaagtcagagacaattaaaccgttattaatttaaagtggtacncagacaaacgaaaccgaagggaaccncccctaagcctcgagtactcagtcgtaccttactcgtagtttcgaacggtaacgggttccgggggtaccctaaggtaaacggtttcaagggttcggatagggtcggatcgggttaagggcctaaaggtttctttaccacttccacacccgtacgttcccgcggttcacgacgtaaaccgtaggtaaacgttcttacaacttaaccttacgtaactcgttaacaactacgttaaccttacgacccgtaccccgcccccgtatacccgttaacccgtaccggaaccggaacggaccgaacgtaacgtaggaaacgttaaacgttaaacggacttgggaccgttcgacgaaccaacttcgttcgttaccttctttaaccgttaaccgtttcccccg

SEQ ID NO: 307779 - DNA, 553 bp, Homo sapiens
  misc_feature: GZ8MTXP01CKTJ1.22.65.F10.1.454.CMB.2.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggganaagtcagagcaataacgtactattaaatggtatcagcaagaacaggaacncccaagctctgatcatgctactctagtttgacaaaggtcgggtcctagtaaggttcaggtggacagtggatcgtagggcagtatttcgactctacactatccgacgtctagacaaccgtgaagtacttcgactaacttactactacgtacaacgtacgtaacttacacgttcccgacccccgtatcctaccgttccggaccgaacgggaccaacgaacgtaggaagtaacttaaacgaagtcggttacgcttgaaccactaacttcgtcttctcgttaacgttccc

SEQ ID NO: 307780 - DNA, 649 bp, Homo sapiens
  misc_feature: GZ8MTXP01B0EQH.22.65.F10.1.454.CMB.2.raw
  modified_base (276)..(276): a, c, t, g, unknown or other
  misc_feature (276)..(276): n is a, c, g, or t
  modified_base (363)..(363): a, c, t, g, unknown or other
  misc_feature (363)..(363): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataaacgtacttaatttaaattggtatcagacaagaaaccgagggaaacncccctaagctcctgatctatgacttaattcctagtttgacgtaaaggttcggggtaccctagaaggttcaggtcggcagtggatcgngggaacagttactttccacttctaccacctactcccgcgtccttacgaccgtaaccgtagtaaacgtacttttaccgacctaaaccttactaacttacgtaacctaaacgtaacgtaaccttaaccgtaccgttccccgacccccccgtactacccgtaacccgttccggaacccgaaacgggaccgaacggtaacggtaaggttaacgtaaacgttaaacgtaacgtaggttcgggttcttcggaacctacctaacttcttgttccttcgttaaccgtttccccg

SEQ ID NO: 307781 - DNA, 657 bp, Homo sapiens
  misc_feature: GZ8MTXP01BC4FM.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctggccggcaagtcagagcaataaacgtacttaatttaaatggtatcagacaagaaaccgagggaaacgcccctaagcctcctagatctatcgtaccttacttcctaggtttcgacgtaaagggttcgggggttaccccgtagtaaacgggttcgaaggttgggctagggtggtatacggtagggaactaagtacttttccaccttcctacacctacgtcccgtacggtctacgacctaaccgtagtaacgtactttacgactaaacttactactagtaccaacacgtaacttaccgacgtaccccgccccccgtatacccgtacccgttaccgggaacccgaaacggggaccaacggaacgtacgggaaagtaaacgttaaacgacgttaggttcggttcttacgaacctacctaacttcgttcgttaccttccgttaacctttccccg

SEQ ID NO: 307782 - DNA, 543 bp, Homo sapiens
  misc_feature: GZ8MTXP01CL526.22.65.F10.1.454.CMB.2.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (528)..(528): a, c, t, g, unknown or other
  misc_feature (528)..(528): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgccggnaagtcagancataacgtatattaaatgtatcagcagaaacaggaaacncccctaagctcngatctatgctacttcagtttgacaaaggtcgggtcctagtaggttcagtggctagtggatcgtagggcagtactttcactcctcacctatccgcgtctgaccaaccgtagaacgtatttacgactaacttactactagtaccaaactacgtaaccgttacacgtcccgaccccccgtatacctacccgttcggaccgaagggaccacgaacgtaggataagttaaacgaactgttcgcttcgcactaactcgtnttactcttcgttccc

SEQ ID NO: 307783 - DNA, 599 bp, Homo sapiens
  misc_feature: GZ8MTXP01BUQ23.22.65.F10.1.454.CMB.2.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatcacctgccgggnaagtcagagcaataaacgtattaattaaatggtatcagacaagaaaccgagggaaacncccctaagcctcctgatctatcgacttacttcctagtttcgacgtaaaggtcggggtaccctagtaaagggttcaggtggactaggtggatcgaggggaactagtactttccaccttctaccgaaacctcgtcccggtcggtactcggacctaaccgtagtaacgtactttacgactaacttactactagtacaacagtacttacacgtccgcccccgtatccaccgttccggaccgaacgggacacgaacgtaggaacgtaaacgttaaacgaacgtggttacggcttcgaaccactaactctcttcttccttaacgttcccg

SEQ ID NO: 307784 - DNA, 821 bp, Homo sapiens
  misc_feature: GZ8MTXP01A2Y1Q.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcataacgtactaatttaaatggtatcagcaagaaaccagggaaacncccctaagctcctgatctatcgcttacttccagtttcgacgtaaagggttcgggggttaccccgtacgaaagggtttccacggttgggacaagggtgggaacttccgttggggaactaggtacttttccaacttctaccaaccgtaacgtcccggtcgggtccgttacggacctaaacccgttaggtaaaacggttactttttacccgggtaacccttaaaacccgttttaacccgttaaacccttaggtttaaaccccgaaaaccgttaaacgggttaaacccctttttaaacccggaacccgggtttaccccggaccccccccccccggtaaactttaccccgttaaacccccggtttaacccggggtaacccccggtaaaacgggggaaaccccgtaaacccgggtaaacccggttaacgggggaaagggtaaaaccgtttaaaaaccgggaaacccgtttagggttaccggggttccttacgggaacccctaacccgttaacgttaccttcgggttaccccttttccgttaaccttttaacccccgg

SEQ ID NO: 307785 - DNA, 785 bp, Homo sapiens
  misc_feature: GZ8MTXP01CTXYN.22.65.F10.1.454.CMB.2.raw
  modified_base (290)..(290): a, c, t, g, unknown or other
  misc_feature (290)..(290): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgaccagtctccatcctcctgtctgcatctgtaggagacagagtcaccatcaccgtggccgggacaaagtcaagagactaattaaacgtacttaatttaaaagttggtaatacaagacaaagaaacccgaagggaaacncccctaaagcctacctagatctaatcgtaccttaacttccgtaaggttttcgaacgtaaacggggttcgggggttacccctaagtaaagggtttcgaaggttcgggactaagggttgggaactttaccggtagggggaacctaaagggtttacttttacccaactttccgtacaacccgtaacgttcccgtcgggttacctacggtaaccaaaccgttacggtaaagttaacgttttaccgaacttaaacctttaactaacttacgttaaccaaacgtaacggtaacctttaaaccgaccggttaccccggacccccccgtaacttacccgtaaccccgttaccgggaacccggaaacggggaaacccaacggaacgttaacgggaaacgtaaaagtttaaaacccggaaacgttgggttacgggttacccgttacgtaacctaacctaacgtttccgttacgtttacctttaaccgttaacccgtttaaccccg

SEQ ID NO: 307786 - DNA, 547 bp, Homo sapiens
  misc_feature: GZ8MTXP01DXO25.22.65.F10.1.454.CMB.2.raw
  modified_base (461)..(461): a, c, t, g, unknown or other
  misc_feature (461)..(461): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggcaagtcagagcataaacgtactatttaaattggtatcagcaagaaaccaagggaaacgcccctaagctcctgatctatgctacttccagtttgacaaaggtggggtcccgtagaaggttcaggtggacagtggatacgtgggaacagtatttccactctacaccatccgcggtctgcaaccgtagaaagtactttacgactaacttactactagtacaacgaacgtacttacacgtccgccccccgtntaccacccgttcggaccgaacgggacacgaactaggataattaaacgacgtgttggcttcgcacaactctgttcttcaacgttccc

SEQ ID NO: 307787 - DNA, 689 bp, Homo sapiens
  misc_feature: GZ8MTXP01B14QG.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcaccgtggccgggacaagtcagagacaattaaacgtacttaatttaaagttggtaatcgaagacaagaaaaccgaagggaaaccacccctaagccttacctagactctaatcgtacttacttccgtagtttacgaacgtaaagggttcggggtaccctagtaaaggttcaggttggactaggtggtatcgagggaactaggttactttccacttcctaccgacctacgtcccgtcggtcctacgacctaaaccgttagaaacgttacgtttacgaaccttaaacttactacttagttaccaaacggtacgtaaccttaccgaccgtaccccgtaccccccgtactaccccgtacccgtccgggaaccgaaacggggtaaccaacgggtaaccgtagggttaaacggtaaacgttaaacgtaacgttgggttacggttccttacgaaccctactaacgttccgttacttccttaacttaacttccccg

SEQ ID NO: 307788 - DNA, 560 bp, Homo sapiens
  misc_feature: GZ8MTXP01BZACU.22.65.F10.1.454.CMB.2.raw
  modified_base (213)..(213): a, c, t, g, unknown or other
  misc_feature (213)..(213): n is a, c, g, or t
  modified_base (328)..(328): a, c, t, g, unknown or other
  misc_feature (328)..(328): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcacatcacctgccgggnaagtcagagcaataacgtactaatttaaatgtatcagcaagaaaccgaagggaacgcccctaagctcctgatctatcgctacttcctagtttgacgtaaaggtcggggtccctanaaggttcagtggcaggtggatcgtgggcagtactttcactctcactctccgcgtctgcaaccgtgaacgtactttacgactaacttactactacgtacaacgacgtacttaccgacgtcccgccccccgatcccgaccttccggaccgaagggaccacgtaacgtaggacgtaaacgttaaacgtacgtggttggcttcgaactactaattctcgttccttcgttcttcccg

SEQ ID NO: 307789 - DNA, 538 bp, Homo sapiens
  misc_feature: GZ8MTXP01AZ77G.22.65.F10.1.454.CMB.2.raw
  modified_base (342)..(342): a, c, t, g, unknown or other
  misc_feature (342)..(342): n is a, c, g, or t
  modified_base (489)..(489): a, c, t, g, unknown or other
  misc_feature (489)..(489): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactatttaaatggtatcagacagaaacagggaacgcccctaagctctgatctatgctacttcagtttgacaaaggtggggtcctgaaggttcaggtggcagtggatcgngggaacagtatttcactctcactactccgtcggtctgctaaccgtgaaagtactttacgactaaacttactactagtacaacacgtacttacacgtccgacccccgtatccgtaccgttcggaccgtaaggaccacgaacgtagganaacgttaaacgaagtgttagcttcgcactaactctgttctcttcgttcc

SEQ ID NO: 307790 - DNA, 694 bp, Homo sapiens
  misc_feature: GZ8MTXP01AWWN7.22.65.F10.1.454.CMB.2.raw
  modified_base (224)..(224): a, c, t, g, unknown or other
  misc_feature (224)..(224): n is a, c, g, or t
  modified_base (686)..(686): a, c, t, g, unknown or other
  misc_feature (686)..(686): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatcgtagtaggagacagagtccaccatccaccgtcggcccgganaagtcagagactaattaaaccgttatttaaattttaaagttggtaactacgacgaacgaaacggaaaacccgaaggggaaaccctaccccctaaagccccttaccgtagtaacttacctagtcgtacctttaaccttccgtaagtttacgaacggtaaagggttccgggggtacccctagtaacggttcaggtggactaggttcggacttacgggtaggggaactaagttactttaccacctttcgaccaaccgtcgtcccggtcggtcctacgacctaaccgtagtaaacgttacgtttaccactaaccttactactacgtaccaaacggtacgtaacttaccgaaccgtcccgaccccctagtccctaaccgtccggaccgaaggccaacggaagtacggaaagtaaacgttaaacgacgttggacgttcacgaaccactaactcgttacttccttaacncgttcccg

SEQ ID NO: 307791 - DNA, 750 bp, Homo sapiens
  misc_feature: GZ8MTXP01EB9CT.22.65.F10.1.454.CMB.2.raw
  modified_base (217)..(217): a, c, t, g, unknown or other
  misc_feature (217)..(217): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacctggccgggnaagtcagagacaattaaacgtacttaatttaaattggtatcagacaagaaaccgaagggaaacncccctaagcctcctagatctatcgtacttacttccgtagtttcgacgtaaagggttcgggggttaccctagtaaaggttcaggtggactaggtggatcggtagggaactagttacttttccaccttcctaccaaccgtacgtcccggtcggttctacggacctaaaccgttaggtaaacggttacttttaccgtaccttaaacctttaacttaacttacgtaaccaaacgtaacgttaacctttaaccgaaccggtaccccgtaccccccccgtaacttaccccgtaacccggtttaccggaacccgtaaacggggaacccaaccgggtaaaccgttaagggttaaacggtaaaacgtttaaaaaccgggtaaaccgttacgggttacggttccgttaccggtaaccctaaacccgttaactttaccgttccggtttaccctttaacccgttaacccgttttccccccg

SEQ ID NO: 307792 - DNA, 676 bp, Homo sapiens
  misc_feature: GZ8MTXP01A3WIB.22.65.F10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcacatcacctggccggnaagtcagncataacgtattattaaatgtatcagacaagaaacagggaaacncccctaaagctcctagactctatcgtacttacttctagtttgacgtaaacgggtcggggtacctagaaaggttcaggtggacaggtggatcgtagggaacagtatttaccacttcctaccgaacctacgtcccgtacggttctacggtacctaacgttagtaaacgtacttttaccgaaccttaaaccttacttaaccgtacgttaaccaaacgtaacgtaaccttaacgaccggttaccccgacccccccgtagttacccgtaaccccgttaccgggaacccgtaaacggggaacctaccggtaacgttaacgggaaacgttaaaccgttaaaacggtaacgtcgggtttacggcgttacggaaccctacctaagtttccttcgttaccttaacgttaaccttttccccgg

SEQ ID NO: 307793 - DNA, 537 bp, Homo sapiens
  misc_feature: GZ8MTXP01EY2H0.22.65.F10.1.454.CMB.2.raw
  modified_base (214)..(214): a, c, t, g, unknown or other
  misc_feature (214)..(214): n is a, c, g, or t
  modified_base (324)..(324): a, c, t, g, unknown or other
  misc_feature (324)..(324): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (437)..(437): a, c, t, g, unknown or other
  misc_feature (437)..(437): n is a, c, g, or t
  modified_base (522)..(522): a, c, t, g, unknown or other
  misc_feature (522)..(522): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataaacgtactatttaaattggtatcagcagaaaccagggaaacgcccctaaagctcctgatctatgcttacttccagtttgctaaaggtcgggtccctnaaggttcaggtggcaggtggatacgtgggaacagtattccactctcacatccgcgtcngcacngaatatttcgactaacttactactagtacaacagtacttaacacgtcccncccccgatcctaccgttccggaccaagggactacgaactggaacgtaagttaaacgaacgtagttaggcttacgcacaacttctnttcttcaactttccc

SEQ ID NO: 307794 - DNA, 624 bp, Homo sapiens
  misc_feature: GZ8MTXP01DYNQV.22.65.F10.1.454.CMB.2.raw
  modified_base (216)..(216): a, c, t, g, unknown or other
  misc_feature (216)..(216): n is a, c, g, or t
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (617)..(617): a, c, t, g, unknown or other
  misc_feature (617)..(617): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggnaagtcagagacaataaacgtacttaatttaaatggtatcagacaagaaaccgaagggaaacgcccctaagcctcctgatctatcgacttacttccgtagtttcgacgtaaacgggttcgggggttaccccttagtaaaggttccgaaggtgggactaggtggtattccgggtaggggaactaggttactttttacccaaccttcctacccgacctacgttcccgggtccggttcttacggacctaaaccgtaggtaaacgttactttacgtacctaaacttactactagtacaaactacgtacttacacgtcccgcccccgtatccaccgtcggaccgaagggtaccacgaactaggagtaacttaaacgactgnggcttcgccactntcgtnttacttcncgttccc

SEQ ID NO: 307795 - DNA, 634 bp, Homo sapiens
  misc_feature: GZ8MTXP01DVH4W.22.65.F10.1.454.CMB.2.raw
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggcaagtcagagacataaacgtacttaatttaaattggtatcagacagaaaccgaagggaaacncccctaagctcctgatctatcgtcttacttccgtagtttcgacgaaagggttcgggggtacccctagaaaggttcaggtggacaggtggatcgttagggaactagtactttacactctacacctagtcccgtcggtctcgacaaccgtagaaagttactttacgacctaaacttaacctacttacgtaccaaacggtaactaactttaaccgacgttacccgacccccccgtatacccgtaacccgttcggacccgaaacgggaccgaacggtaacgtaggaacgtaaacgtttaaacgaaacgttggttacggttcttacggccaacctaagttctacgttccttcgaacgtttcccg

SEQ ID NO: 307796 - DNA, 667 bp, Homo sapiens
  misc_feature: GZ8MTXP01DVM2J.22.65.F10.1.454.CMB.2.raw
  modified_base (191)..(191): a, c, t, g, unknown or other
  misc_feature (191)..(191): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagacgtcaccatcacctggccgggacaagtcagagacaattaacgtattaatttaaattggtatcagacaagaaaccgaggaacncccctaagctctgatctatcgtacttacttctagtttcgacgtaagggtcgggtaccctagaaggttcaggtggactaggtggtactcggttagggaactagttactttacccacttcctacaccgtacgtcccgtcggttacacggtacctaaaccgtaggtaaacttacgttttaccgaacttaaaccttacttaacgttacgtaaccaaacgtacgttaaccttaaccgaccggtccccgaccccccgtagtacccgttaacccgtccggtaaccgaaacgggtaccaaacggtaacgtaacggttaaggtaaacttaaacggtaacgttgggacgttcttacgaacctacctaacgttctcgttacccttcgttaacctttcccg

SEQ ID NO: 307797 - DNA, 634 bp, Homo sapiens
  misc_feature: GZ8MTXP01DJX0E.22.65.F10.1.454.CMB.2.raw
  modified_base (216)..(216): a, c, t, g, unknown or other
  misc_feature (216)..(216): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctggaccgggnaaagtcaagagacaattaaacgtacttaatttaaagttggtatcagacaagaaaccagggaaacncccctaagctcctgatctatcgtcttacttcctaggttttgacgtaaagggttcgggggtaccctagtaaacgggttcaaggtgggactaggtgggatacggtagggaacagtactttcactctacacactccgcgtctacgacaactgaacgtattacgactaacttactactgtacaacgtagtaccttaccacgttcccgaccccccgtatacccgtacccgttaccgggacccgaaaggggaccacggtaacgtacgggaaagtaaacgtttaaacggaaaccgttgggttacgttccgttacgaaccctacctaacttccgttcgttaccttccttaactttcccccg

SEQ ID NO: 307798 - DNA, 618 bp, Homo sapiens
  misc_feature: GZ8MTXP01DRHVF.22.65.F10.1.454.CMB.2.raw
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggcaagtcagancataacgtactatttaaatgtatcagcaagaaaccagggaaacncccctaaagctcctagatctatcgacttacttcctagttttgaccgtaaaggtcgggggtaccctacgtaaagggtttccaggttggactagggtaggtaactcgttgggggaacctagtactttaccacctctaccgaccactccgacggttctgaccaaccgtgaaagttactttcgactaacttactactagtacaaactagtacttacacgtcccgaccccatcctaccttcggaccgaacgggacaacgaacgtacggaagtaaacgttaaacgaaaccgttggttacgggccttacggccaaaacccgttcttaccgttacgttaccttaaccttaaccgttcccg

SEQ ID NO: 307799 - DNA, 606 bp, Homo sapiens
  misc_feature: GZ8MTXP01AEXX8.22.65.F10.1.454.CMB.2.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtactatttaatgtatcagcagaaacaggaacncccctaagctctgatctatgcttacttcctagtttgacgtaaggttcggggtaccctagaaggttcaggtggacaggtgatcgtagggaacagtactttcactctacacctatccgcgtctacgacctaacctagtaacgtactttaccgactaacttactactacgtaccaaacgtacgtaaccttaccgaccgtaccccgaccccccgtatacccgtacccgttccggaccgaaacgggaccaacggtaaccgtaagggaacgtaaacgttaaaccgaacgttggttacggccttcgaacctaccgtaacttccgtcgttccttcgttaacgtttccccg

SEQ ID NO: 307800 - DNA, 692 bp, Homo sapiens
  misc_feature: GZ8MTXP01CG5VT.22.65.F10.1.454.CMB.2.raw
  modified_base (281)..(281): a, c, t, g, unknown or other
  misc_feature (281)..(281): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagactaattaacgtacttaatttaaattggtatcagacaagaaaccgaagggaaacncccctaagcctcctgactctaatcgtaccttacttccgtagtttacgacgtaaacgggttcgggggtacccctagtaaacgggtttcgaaggttcgggactagggtaggacgttaccggtagggggtaacctaagggtttaacctttttaccgaacctttcccgtaccctaaacccgtaccgttccccgggtaccgggttactacggtacctaaacccgttaggtaaaccgttactttaccgaactaacttacctactacgtacaacgtacgtaacttaccacgtacccgccccctataccctacccgtacggaccgaacggacaacgtaacgtaggaacgtaaacgttaaacgacgtggttcggttcttacgcctacctaattcgtgttaccttcgttaacgtttccccg

SEQ ID NO: 307801 - DNA, 589 bp, Homo sapiens
  misc_feature: GZ8MTXP01D4P5U.22.65.F10.1.454.CMB.2.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (388)..(388): a, c, t, g, unknown or other
  misc_feature (388)..(388): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccgggcaagtcaganacaataacgtactaattaaatgcancagacagaaacagggaaacncccctaagctctgatctatgacttacttctagtttgacgtaaggtcgggtacctagaaggttcaggtggactaggtgaactcgtgggactagtactttcactctcaccactccgcgtcncgactaacgtagaatacttacgactaacttactactacgtacgaactaagtacttacgaccgtcccgcccccgtatacccgtaccgttaccggaccgaacggggaccaacggtacgttagggtaacgttaaacgttaaaacggtaacgttcggttcggcgttaacgacctaacctacttccttcgttccttcgttaacccg

SEQ ID NO: 307802 - DNA, 624 bp, Homo sapiens
  misc_feature: GZ8MTXP01C8QTQ.22.65.F10.1.454.CMB.2.raw
  modified_base (214)..(214): a, c, t, g, unknown or other
  misc_feature (214)..(214): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggnaagtcagagacaataaacgtactaatttaaatggtatcagacaagaaaccaagggaaacgcccctaagctcctagatctaatgtacctaacttccagttttcgacgaaaggttcgggggtacccctagtaaaggtttcaaggttggacgaggttgggaactcgtaggggaactagtatttacactctacaccatccgtcggtctcgactaacctagaaagtacttacgactaacttaactactacgtacaaactaacgtactttaaccgacgttacccgcccccccggatcccgtaaccgttccggaccgaaacggggacacggtaaccgtaggaacgtaaacgttaaacgtaaaccgtggttacggcttacgccaaacccgttctcttcgttccttcttaacgttcccg

SEQ ID NO: 307803 - DNA, 599 bp, Homo sapiens
  misc_feature: GZ8MTXP01BC7NB.22.65.F10.1.454.CMB.2.raw
  modified_base (215)..(215): a, c, t, g, unknown or other
  misc_feature (215)..(215): n is a, c, g, or t
  modified_base (581)..(581): a, c, t, g, unknown or other
  misc_feature (581)..(581): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggnaagtcagagctaataaacgtacttaatttaaattggtatcagacaagaaaccagggaaacgcccctaaagctcctgatctatcgcttacttcctagtttcgacgtaaaggttcgggggtaccctacgaaaggtttcaaggtggctaggtggatcgtggggaactagtactttcaccttctaccacctacgtcccgtcggtctcgaccaaccgtagaaacgtactttacgactaaacttactactagtactaacacgtacttaaccacgttcccgccccctactccaccgttcggacccgaacgggaccacgaacgtaggaagtaaacgttaaacgaaacgtggttacgcttcgaacaccaattctnttcttcttaacgttcccg

SEQ ID NO: 307804 - DNA, 692 bp, Homo sapiens
  misc_feature: GZ8MTXP01AJDL9.22.65.F10.1.454.CMB.2.raw
  modified_base (290)..(290): a, c, t, g, unknown or other
  misc_feature (290)..(290): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatcccagatgacccagtctccatccctccctgtctgcatctggtaggagacagacgtcaccatcacctggccggcaagtcagagactataacgtacttaattaaatggatcagacaagaaaccagggaaactcccctaagctccngtatctatgtacttacttccgtaagtttgaacgtaaagggttcgggggttacccctagtaaacggtttcgaacgggttggacgtaaggttggggaactttcccgggtaggggaacctagtttaaccttttcaacccttccttacggaaccctcgtcccggtcggtcctacggaccaaccgtacggtaaagtacttttacccggaacttaaacctttaaccgtacgttacgttaaccaaaccgtaacggtaaccctttaaacccgacccggtacccccgtacccccgtacgtaccccggtaacccggtaccgggaaccggtaaacgggacctaacggaacgtaggttaacgtaaacgttaaacgtacgtggttacgcttcgcactctctcttcttcttctccg

SEQ ID NO: 307805 - DNA, 689 bp, Homo sapiens
  misc_feature: GZ8MTXP01DB7W9.22.65.F10.1.454.CMB.2.raw
  modified_base (279)..(279): a, c, t, g, unknown or other
  misc_feature (279)..(279): n is a, c, g, or t
tcagacatacgcgtcacgaccggtgctcgatttagctacgctctaagggggagtcagtctcagtcaggacacagcatggacatgagggtccccgctcagctccgtggggctcctgctactctggctccgaggtgccagatgtgacatccagatgacccagtctccatcctcctgtctgcatctgtaggagacagagtcaccatcacctggccggacaagtcagagacaattaaacgtacttaatttaagtggtatcagacaagaaaccgaagggaaacncccctaagcttacctagactctaatcgtaccttacttccgtagtttcgaacgtaaacgggttccggggttaccctagtaaggtttcaaggtcggactaggtgatcgtagggaactagtactttcgactcctacactacgtccgtcgtctacgactaaccgttgaaacgttctttacgaacctaaacttacgtacgtacgtaacctaaacggtacgttaaaccctttaacgaccggttccccccgaacccccgtagttaccccttaacccgggttcccggaaccgtaaacggggaccctaaacggtaaccgtaagggaacgttaaaacgttaaaccggacgttagggttacggacttacggtaaccctaaccgttcgtttccgtacgttacctttccgttaacccgttccg

SEQ ID NO: 307806 - DNA, 583 bp, Homo sapiens
  misc_feature: GZ8MTXP01ETZ8P.22.65.F10.1.454.CMB.2.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtcctccactcctccctgtctgcatctgtagganacagagtcacatcacctgccggnaagtcagancaataacgtactaatttaaatggtatcagacaagaaaccaggaaacncccctaagctcngatctatcgctacttccagtttagacgtaaaggtcggggtccctagtaaggttcaggtggactaggtgaactcgtagggctagtatttccactctacacactccgcggtctcgacaactagtaagcttacgactaaacttactaactacgtacaaacggtactaacttacaacgtcccgaccccccgtactaccgtacccgtccggaccgaacggaccaacgaacgtaggaacgtaaacgttaaacgaaacgtcagggcttcggaacacgtaactcttcgttacttcttaacgttcccc

SEQ ID NO: 307807 - DNA, 621 bp, Homo sapiens
  misc_feature: GZ8MTXP01ADXAY.22.65.F10.1.454.CMB.2.raw
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatcacctgccggcaagtcagagcaataacgtacttattaaatgtatnagacaagaaaccgagggaaacncccctaagctcctgtatctatcgtcttacttccgtaggttttgacgtaaagggttcggggtacccgtagtaaaggtttccaggtggctaaggtggatcgtagggaactagtactttcgactctcaactctccgcgtctcgacaactgaacgtactttcgaactaacttactactacgtaacaacgtactaaccttacgaccgtccccgacccccgtatccccgtaacccgttccggaaccggaaacggggacccaacggtaaccgtaagggttaaacgtaaacgttaaacgtacgtggttacgccgttagtaaccacctaattcctcgtttcctccgttaaccgtttcccg

SEQ ID NO: 307808 - DNA, 657 bp, Homo sapiens
  misc_feature: GZ8MTXP01DUPWD.22.65.F10.1.454.CMB.2.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcactgccggnaagtcagncataacgtatattaatgancagcaagaaaccaggaacncccctaagctactgatctatcgtcttacttcagtttcgacgtaaagggttcgggggttacccctagaaggttcagtggactaggtggatcgtagggaactagtacttttacccacttcctacaccgtacgtcccggtcggttctacgacctaaccgttagtaaacgttactttaccgtaacctaaacttacctacttacgtaccaaacgtacgttaaccttaaccgtaccgtaccccgaccccccgtactacccgtaacccgttaccggacccgtaaacgggaccgaacggtaacgtagggttaaacgtaaacgtttaaacgtaacgttacggttcggttccgttacggaaccctacgtaacttcgttcgttacctttaaccgttaaccgtttccccg

SEQ ID NO: 307809 - DNA, 577 bp, Homo sapiens
  misc_feature: GZ8MTXP01BXQ94.22.65.F10.1.454.CMB.2.raw
  modified_base (216)..(216): a, c, t, g, unknown or other
  misc_feature (216)..(216): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtactatttaaattggtatcagacaagaaaccagggaaacncccctaagctctgatctatnctacttcctagtttcgacgtaaaggtcgggtaccctagtaaggttcgaggtggctaggtggatcgngggaactagtatttcactctacacctactccgtcgtctgacaacctagaagtacttacgactaacttactactagtacaacgaacgtacttacacgtcccgcccccgtatcctaccgttcggaccgtaacgggaccaacgaacgtaggaaacgtaaagttaaacgaacgtcggttacggttcttacgaaccacaacttctcgttcttcgaacttcccg

SEQ ID NO: 307810 - DNA, 733 bp, Homo sapiens
  misc_feature: GZ8MTXP01CIN09.22.65.F10.1.454.CMB.2.raw
  modified_base (213)..(213): a, c, t, g, unknown or other
  misc_feature (213)..(213): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggnaagtcagagcaataaacgtacttaatttaaatggtatcagcaagaaaccagggaaacncccctaagctccagactctatgccttaacttccgtaggttttcgacgtaaacgggttcgggggttacccctagtaaaggggtttccaaggttgggactagggttgggaacttccgggtaggggaacctaagggttaactttttcccgaactttccctacccaaaccgtacgttcccgggtccggttccgtacggtaccgtaaacccgttaaggtaaacggttacttttaccggtaaccttaaaccgtttaaccttaaccttacggtaaccctaaacggtaacggtaacctttaaccgaccggttccccgtacccccccggtactacccgtacccgtttaccggacccggtaacgggtaaccgacggtaaccgttagggaagtaaacgttaaacggtaaaccgttggttacgttcgttcggtaaccactcttcgttcggttaccttccgttaacgtttccccg

SEQ ID NO: 307811 - DNA, 606 bp, Homo sapiens
  misc_feature: GZ8MTXP01DDK44.22.65.F10.1.454.CMB.2.raw
  modified_base (190)..(190): a, c, t, g, unknown or other
  misc_feature (190)..(190): n is a, c, g, or t
  modified_base (274)..(274): a, c, t, g, unknown or other
  misc_feature (274)..(274): n is a, c, g, or t
  modified_base (366)..(366): a, c, t, g, unknown or other
  misc_feature (366)..(366): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgaccgagcaagtcagagctaataacgtacttatttaaatggtatcagacaagaaaccgagggaaacncccctaagctcctagatctatcgtacttacttctagtttagacgtaaaggttcgggtacctagaaggttcaggtggctaggtggaacttcgngggactagtactttcactctacacctacgtccgcgtctacgactaacctagtaactactttcgaacttaacttaactacttacgtactaaacgtacgtaaccttaccgacggtaccccgcccccgtatcccgtacccggttccgaaccgaacgggacaacggtacgttaggaaacgttaacgttaaacgattcgggttcgacgtaacacctaactacgtcgttcttccgttcttaacccg

SEQ ID NO: 307812 - DNA, 592 bp, Homo sapiens
  misc_feature: GZ8MTXP01CTX22.22.65.F10.1.454.CMB.2.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (242)..(243): a, c, t, g, unknown or other
  misc_feature (242)..(243): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcactgccgganagnagananaataatataattaagtgtannagacaagaacgaaggaacncctagctcanatctatctacttactcgtagttagacgtaacggtcggtaccgtagtaagtcgacggtggacgtaggtagtacgtacggtaggaactagtacttacactctacactcgtccgtcgtacgtacgactaacgtagtaagtacttacgactaacttactactactacaacgtaacgtacctaccgaccgtcccgaccccgtacgtaccctaccgtaccgaaccgaaacggaacgaacgtaacgtaacggaaacgtaaacgttaaacgtaacgtggttcgcgttacgaacctactaactcttacgttaccttcgttaacgtcccg

SEQ ID NO: 307813 - DNA, 701 bp, Homo sapiens
  misc_feature: GZ8MTXP01D7K6P.22.65.F10.1.454.CMB.2.raw
  modified_base (371)..(371): a, c, t, g, unknown or other
  misc_feature (371)..(371): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtcctgcatcgtgtaggagacagagtcacatcacctgccgggacaagtcagagactaataaaccgtataatttaaattggtatcagcaagaaaccgaaggaaacgcccctaagctcctgatctaatcgactaactttccgtagtttcgacgtaaaggttcgggggtacccctagtaaacggttccaaggtccgggtanaggttgggaacttcggtaggggaacctaggtacttttaccaaccttcgtacccaccgtacgttcccgtcgggttacctaggacctaaaccgtagtaaaacggttacgttttaccgacctaaacctttaactaccttagttaaccccaaagtactaacctttaccgaacgttccccggtaccccccgatacccgtaccgttccggaccgtaaacgggacacggtaaccgtacgggttaagtaaacggttaaacccgtaagttcggttacgggttcttacggaaccctaaccgtaacgttcgttacgttacctttaacgttcgtttcccccg

SEQ ID NO: 307814 - DNA, 625 bp, Homo sapiens
  misc_feature: GZ8MTXP01BL9E3.22.65.F10.1.454.CMB.2.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctggccggacaagtcagagcaattaaacgtacttaatttaaagttggtatcagacaagaaaccgagggaaacncccctaagcctctgatctatcgtctacttcagtttcgacgtaaagggttcggggtacccttagaaggtttcaggttggctaggtggattcgtaggggaactagtactttccacttctacacctactcccggtcgtctacgaccaaccgtgaaacgttctttacgactaacttactactagtacaaacgtacgtaaccttacgacgttacccgacccccgtacgtacctaacccgttccgggaccgaaacggggaccaacggtaacgttaacggaagtaaacgttaaacgaacgttcggttcggcttcgaacctacctaattcgtcttaccttccttaacgttccccg

SEQ ID NO: 307815 - DNA, 637 bp, Homo sapiens
  misc_feature: GZ8MTXP01EG3C5.22.65.F10.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtaggagacagagtcaccatccacctggccgggnaagtcaganacaattaacgtattatttaaagtggtatcagacaagaaaccgaggaacncccctaagctacctgactctatcgtcttacttctagtttcgacgtaaggtcggggttaccctagtaaggttcaggtggactaggtcggtaatcgtaggggaactaggtactttccacttctacacctacgtccgtcggtctacgactaaccgtaggtaaacgttactttacgactaaccttactaactacgtaactaaacggtaactaccgttaaccgtaccggtaccccgaccccccgtacttacccgtaacccgttccggaaccgtaacggaaccgaacgtaacgtaggaaagtaaacgttaaacgacgtacgttcggcttacgaacctactaacttctcgttcttcttaacgttccc

SEQ ID NO: 307816 - DNA, 632 bp, Homo sapiens
  misc_feature: GZ8MTXP01D6TYE.22.65.F10.1.454.CMB.2.raw
  modified_base (190)..(190): a, c, t, g, unknown or other
  misc_feature (190)..(190): n is a, c, g, or t
  modified_base (218)..(218): a, c, t, g, unknown or other
  misc_feature (218)..(218): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccatcacctggccggganaagtcagagactaataaacgtacttaatttaaattggtaatcagacaagaaaccgaagggaaacgcccctaagctcctagattctatcgtccttaacttcctagttttacgacgtaaagggttcgggggttaccccgtagtaaacgggtttcaggttcggacgtaaggtggtaactccgtaggggaactagtactttacaccttctacaccgtactcccgcggttctcgacctaaccgtagtaacgtactttacgactaacttactactagtacaacgtagtactacacgtcccgcccccgtatccgtaccgttccggaccgaacgggacaacgaacgtaggaaacgtaacgttaaacgtaacgtcggttacggcttacgctactaactcgtcttccttccgttaacttccccg

SEQ ID NO: 307817 - DNA, 620 bp, Homo sapiens
  misc_feature: GZ8MTXP01BEKFW.22.65.F10.1.454.CMB.2.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagagtcaccatcaccgtggccggganaagtcagagactaattaaacgtattaatttaaagtggtatcagacaagaaaccgagggaacncccctaagcctctagatctatcgtaccttacttcgtagtttcgacgtaaagggttccggggtaccctagaaggttcaggtggctaggtggatcggtgggaactagtactttcacttcaccactacgtccgtcgtctcgacctaaccgtagaacgttactttaccgaccttaacgttacttactagttaaccaacgtacgtaaccttacgaccggtccccacccccgtatcccgtaccgtcggacccgaaacgggaccacggtaacgtaggaacgtaaacgttaaaccgaagtcggcggacttcgaacctactctacgtcttcctaacttccgttccc

SEQ ID NO: 307818 - DNA, 580 bp, Homo sapiens
  misc_feature: GZ8MTXP01CKF5K.22.65.F10.1.454.CMB.2.raw
  modified_base (217)..(217): a, c, t, g, unknown or other
  misc_feature (217)..(217): n is a, c, g, or t
  modified_base (274)..(274): a, c, t, g, unknown or other
  misc_feature (274)..(274): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctggccgggnaagtcagagcaataacgtacttatttaaatggtatcagcaagaaaccgagggaaacncccctaagctcctgactctatcgtactacttcctagtttgacgaaagggttcgggtaccctagaggttcaggtggcaggtggatcgtagggaacngtacttcactcncaccatccgcgtactgaccaacctagaacgttacttcgactaacttactaactgtacaacgacgtaacttacacgtccccgacccccgtatcccgtaccgtccgaccgaacggaccacgtaactaggagtaacgttaaacgaaccgtggttcggcttcgaaccaacttctcgttgttacccttcgttaaccgtttcccc

SEQ ID NO: 307819 - DNA, 610 bp, Homo sapiens
  misc_feature: GZ8MTXP01A2DFT.22.65.F10.1.454.CMB.2.raw
  modified_base (286)..(286): a, c, t, g, unknown or other
  misc_feature (286)..(286): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagcataacgtactatttaaatggtatcagacaagaaaccgagggaaacgcccctaagctcctnatctatgacttacttccagtttcgacgtaaggtcgggtcctacgaaggttcaggttggcgagtggactcgtgggaactagtactttcactcctacaaccgtactcccggtcggtactcgacctaaccgtagtaaacgtactttaccgacttaacttacctactacgtaacaacgtaacgtactttaccgacgtcccgtaccccccgtatacccgtacccgttccgacccgaaacgggaccaacggtaacgtagggaaactaacgttaaacgtaacgtggttacgcttacgaaccactaacttctcgttcttcttaacgttcccg

SEQ ID NO: 307820 - DNA, 648 bp, Homo sapiens
  misc_feature: GZ8MTXP01ACXWA.22.65.F10.1.454.CMB.2.raw
  modified_base (220)..(220): a, c, t, g, unknown or other
  misc_feature (220)..(220): n is a, c, g, or t
  modified_base (278)..(278): a, c, t, g, unknown or other
  misc_feature (278)..(278): n is a, c, g, or t
  modified_base (535)..(535): a, c, t, g, unknown or other
  misc_feature (535)..(535): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccatcctccctgtctgcatctgtaggagacagacgtcacatccaccgtggccgganaagtcagagacaataacgtactaatttaagtgtatcagacaagaaaccgagggaaccncccctaagctacctagactactagtctacttaccttcgtagtttacgacgtaaacgggtcgggtaccctagtaaacggtttcgaaggtcgggacgtaggttacggacttaccgggtagggtaacctaggttactttccaacccttcaccgaacctaccgtcccgtacgtctacggaacctacgtagtaacgttacttaccgactaaccttacgacttagtaacaacgtagtaaccttacgaccggtcccaccccgtntacccgtaccgtacggtaaccgaaaggaccaaggtaacggtaaggaacgtaaacttaaacggcgttaggcggttacacgaactactaactctacgttcctaacgttcttcccg

SEQ ID NO: 307821 - DNA, 557 bp, Homo sapiens
  misc_feature: GZ8MTXP01DVQ4U.22.65.F10.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (461)..(461): a, c, t, g, unknown or other
  misc_feature (461)..(461): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgaccccagtctccatcctccctgtctgcatctgtaggagacagagtcaccatcacctgccgggnaagtcagancataaacgtactatttaaatggtatcagcagaaacaggaaancccctaagctccngatctatgactacttccagtttcgacaaaggtggggtacccctgaaaggtttcaggtggcagtggatcgtgggcagtaactttcaactctcgacctactcccgcggtctcggctaaccgtagaaagtactttacgactaacttactactgtacaacgtagtacttacagtccgacccccgntccaaccttcgaccaacgggacacgaacgtggagaagtttaaacgaaacgtgttacggcttacggcaacctaatctcgttcttaacgcgtttcccg

SEQ ID NO: 307822 - DNA, 562 bp, Homo sapiens
  misc_feature: GZ8MTXP01BTUA5.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactatttaaattggtatcagcaagaaaccgaagggaaacgccccctaagctcctgatctatgctacttcctagtttgctaaaggtcgggggtacccctagaaaggttcaggtggacgtagtggatcgtgggcagtatttcactctcacatccgcgtctgcaactgaagtatttacgactaacttactactagtacaacgaagtacttacacgtccgccccccgtatcccgtacccttccggaccgaacgggaccacggaaccgtagggataaacttaaacgaacgttggcggcttcgcctacaacttctacttcttcttaacgttccccg

SEQ ID NO: 307823 - DNA, 582 bp, Homo sapiens
  misc_feature: GZ8MTXP01A6N86.22.65.F10.1.454.CMB.2.raw
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcattaaacgtactatttaaatggtatcagcaagaaaccgagggaacncccctaagctcctgatctatgcttacttcctagtttagactaaaggtcgggggttaccctagaaaggtttcaaggttggctaggtggactcgtaggggaactagtacttttccacttctacacctatcccgcggtctcgacctaacctagaagtactttacgactaacttactactgtacaacacgtacttacgacgtccgcccccgtatcctaccgttccggaccgaaggaccacgaactaggaacgtaacttaaacgaacgtggttacggcttcgaacacctaactctcttccttcgttaacttccccg

SEQ ID NO: 307824 - DNA, 654 bp, Homo sapiens
  misc_feature: GZ8MTXP01D40M3.22.65.F10.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagatcacatcacctgccggnaagtcagancaataacgtactatttaaatgtatcagacaagaaacgagggaaacncccctaagctcctagatctagtctaccttacttaccgtaggtttcgaacgtaaaggggttcgggggtaccccttagtaaaggttcaaggtcgggactagggtggaacttcgtagggaacgtagtatttccaactctaccacctacgtccgcggtctcgactaacctagtaaagtcttacgactaacttactactagtaccaaactacgtaacttacgaccgtcccgacccccgtatacccgtaccgtaccggaccgtaaacggaccaacggtaaccgttaaggaacgtaaaacgtttaaaccggaaacgttcgggttacggttcgttaccggaaccgtaaaccgttctttccgttacgttccctttaacttaacccgtttccccg

SEQ ID NO: 307825 - DNA, 651 bp, Homo sapiens
  misc_feature: GZ8MTXP01EYYZB.22.65.F10.1.454.CMB.2.raw
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccacctggccgggnaagtcagagacaataaacgtacttaatttaaagttggtatcagacaagaaaccgaaggaaacncccctaagctacctgactctatgcttaacttctagtttcgacgtaaagggtcggggtacctagtaaggttcaggtggctaggtggtatacgtagggaactaggtactttccacttcctacacccgtacgtccgtcgtcgtacgaccaaccgtagtaaacgtactttaccgactaacttactacgttacgtaactaactaacgtaacttaaccgacccgtcccgtaccccccgtattacccgtaacccgttccgggaaccgaacgggtaaccgaaccggtaacggtacggaaacgtaaacgttaaaaccggtacgttggacgttcgttacgtaaccacctaacttcgtacttccttcgttaacgttccccg

SEQ ID NO: 307826 - DNA, 706 bp, Homo sapiens
  misc_feature: GZ8MTXP01BV2NL.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcacatcacctggccgganaagtcagagcaataacgtacttaattaattggtatcagacaagaaaccaagggaaacacccctaagcctcctagatctatcgtcttaccttcctagtttacgacgtaaaggttcgggggtacccctagaaacgggtttcgaaggttggacgtaggtacgggtacgttacgggttacggggaacgtaagttacttttaccaaccttccgttaccacccgtactcccgggtcggttcctacggtaccaaacccgttaggtaaacgttacgtttacctaacttaaaccttaccgtaacttacgtaacctaaaccgtaacggtaaccttaaccgaccggttaccccgacccccccgttacgtacccgtaccccgttcggaacccgtaaacgggtacccgtaacggaaccgtagggttaaacgtaaacgttaaacgtacggtagttacggcacggtaaccacctaacttcgtaccttcttcgttaacgtttccccg

SEQ ID NO: 307827 - DNA, 657 bp, Homo sapiens
  misc_feature: GZ8MTXP01DYTW5.22.65.F10.1.454.CMB.2.raw
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctccactccctccctgtctgcatctgtaggagacagatcacatcacctgccggnagcagncataactatattaatgancagcaagaacgaggaacnccctaagctcngatctatcgtacttacttccgtagtttcgaacgtaaggttcggggtacccctagaaaggttcaggtggactaggtgactcgtagggaactagtactttacacttcacaacctcgtccgtacgtctcgactaaccgtagtaacgttacttctaacctaacttaactacttacgtaacctaaacgtaacgtaaccgttaccgtaccgttccccgaccccccgtacgttacccgtacccggttacccggaaccggtaaaccgggaaccgtaaccggtaacgttaacgggttaaacgttaaacgttaaaaccggtaaacgttcggttaaccggttcgttacgaaccctaccgttaacgtttcttcgttacctttaaccttccgtttaaccccg

SEQ ID NO: 307828 - DNA, 599 bp, Homo sapiens
  misc_feature: GZ8MTXP01ANFUN.22.65.F10.1.454.CMB.2.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactatttaaatggtatcagcagaaaccagggaaacnccccaagctacngatctatgcttacttccagtttacgacgtaaaggtcgggggtaccctagtaaggttcaggtggcaggtggatcgttagggaactaggtactttcgactctcaccgtatccgcggtctacgactaacctgtaacgtacgtttacgactaaacctttactactacgtacaacgtaacgtaccttacaccgtccgccccccgtatacccaccgttccggaccgtaacgggacctacggaactagggaactaacgttaaaccggaactcggttacggttcgacggcctaccaacttcgtcgttcttcgttaaccgtttccccg

SEQ ID NO: 307829 - DNA, 524 bp, Homo sapiens
  misc_feature: GZ8MTXP01AZJVC.22.65.F10.1.454.CMB.2.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (481)..(481): a, c, t, g, unknown or other
  misc_feature (481)..(481): n is a, c, g, or t
  modified_base (500)..(501): a, c, t, g, unknown or other
  misc_feature (500)..(501): n is a, c, g, or t
  modified_base (519)..(519): a, c, t, g, unknown or other
  misc_feature (519)..(519): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtatatttaaatggtatcagcagaaaccagggaaagcccctaagctctgatctatgctaacttccagtttagactaaaaggttcgggggtccctacaaagggtttcaagtgggcaagtggatcgtgggaacagatttcactctcaccgatccgcggtctgcaaaccttgaagtatttcacaacttacactagtacaacganacttanacgtcgcccccatccaccttcggacaaagggcacgaactgganattaaacgaactgttagcnncacctaatcttgttctcnctccg

SEQ ID NO: 307830 - DNA, 567 bp, Homo sapiens
  misc_feature: GZ8MTXP01BLUFN.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcaataaacgtactaatttaaattggtatcagacaagaaaacccagggaaagccccctaaagctacctgatctatgcttacttccagttttgctaaaggtgggtccctagaaggttcagtggcagtggatcgtgggcagtatttcactctcacatccgcgtctgcaacctgaagtatttcgactaacttactactgtacaacgacgtacttaccacgttaccgcccccccgtaatcccgtaaccgttccggaccgaaacgggaccaacgaaccgtgggaacgtaaactttaaacggaaccttagcgggttacttcaaccactaatctcgttctcttaacttcccg

SEQ ID NO: 307831 - DNA, 781 bp, Homo sapiens
  misc_feature: GZ8MTXP01APW6A.22.65.F10.1.454.CMB.2.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacctggccggganaagtcagagcaattaaacgtacttaatttaaagttggtatcgagacaagaaaccgagggaacncccctaagcctacctagatctatcgacttacttcctagtttcgacgtaaacgggttcgggggtacccctagtaaacggtttccgaaggttcgggacgtaagggttcgggtaacttcccgggtagggggtaaccctaggtttaacctttttacccgaacctttccgtacccctaacccgtaaccgttcccgggtccggttaccgttacggaccctaaacccgttaggtaaaacgttacgttttacccggaaccttaaaccgtttaaccttaaccgtacgttaaccctaaacggtaacggttaaccctttaaccgacccggttacccccggaccccccccgtaagttaccccgtaaccccggtttacccgggaaacccggaaaccggggtaacccaaccgggtaacgtacggaaacggttaaaccgttaaaccggacgttacgggcgttccgttacgtaaccctaacctcgttctcggttaccttccgttaacgtttccccg

SEQ ID NO: 307832 - DNA, 658 bp, Homo sapiens
  misc_feature: GZ8MTXP01AOTBF.22.65.F10.1.454.CMB.2.raw
  modified_base (304)..(304): a, c, t, g, unknown or other
  misc_feature (304)..(304): n is a, c, g, or t
  modified_base (398)..(398): a, c, t, g, unknown or other
  misc_feature (398)..(398): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccacctggcccgggacaagtcaagagactaattaaacgtacttaattttaaagtggtaatcgaagacaacgaaaaccgagggaaacgcccctaaagcctcngactctatcgtactacttccagtttgacgtaaaggtcgggtccctagtagttcgagtggcagtgatcgtagggaacctagtactttccaccttntaccactactccgcgtctcgacaacgtagaacgtactttacgactaacttactactacgtacaacgtaacgtaccgttacgaaccgttccccggacccccgtaatacccgtacccggttaccggaacccggaaacgggaacccgtaacggtaaccgtaacgggttaaacgtaaaccgttaaacggtaaacgtcggttacgggcttacggaacctaaccgtcgttcccgttagttcccgtttaaccgttaacctttccccg

SEQ ID NO: 307833 - DNA, 583 bp, Homo sapiens
  misc_feature: GZ8MTXP01CFI1K.22.65.F10.1.454.CMB.2.raw
  modified_base (335)..(335): a, c, t, g, unknown or other
  misc_feature (335)..(335): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaaagtcagagcaataaacgtactaatttaaaattggtatcagcaagaaaaccagggaaagcccctaaagctcctgatctatgcttaacttccagtttgacaaaaggtgggggtccccgtnaaaggttcacgtggcagtggatcgtgggcagatttcactctcaccatccgcggtctgcaaacctgaaaggttctttacgactaaacttactaactgtaccaaacgacgtaacttaactacgtaccgcccccgaccgtacctaccttaccgtaccgaacggaacgaacgaacgtacggaagaaagttaaacgtaaacgtacggttaggttcgttcgaacacctaactacttcgttcttccgttcgttcc

SEQ ID NO: 307834 - DNA, 600 bp, Homo sapiens
  misc_feature: GZ8MTXP01EBGZX.22.65.F10.1.454.CMB.2.raw
  modified_base (214)..(214): a, c, t, g, unknown or other
  misc_feature (214)..(214): n is a, c, g, or t
  modified_base (221)..(222): a, c, t, g, unknown or other
  misc_feature (221)..(222): n is a, c, g, or t
  modified_base (239)..(240): a, c, t, g, unknown or other
  misc_feature (239)..(240): n is a, c, g, or t
  modified_base (259)..(259): a, c, t, g, unknown or other
  misc_feature (259)..(259): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccactcctccctgtctgcatctgtaggagacagatcacatcactgccggnagcagannataagtatattaatgannagacaagaacgaaggaacnccctaagctactgactctatcgacttacttcgtagtttcgacgtaagggtcgggttaccctagtaaggttcaggtggactaggtgactcggagggaactagtactttcactctacaccgtgtccgcgtactcgactacgtagaagtactttacgacttaacttactactacgtaaccaacgtacgtaaccttaccgaccgtaccccgacccccgtactaccgtacccgttaccggaacccgaaacgggaccgaacggtaacgtaggaaacgtaaacgtttaaacgaacggtgttacggttcttacgcctaactcttctcttcttaacttcctttaaccccg

SEQ ID NO: 307835 - DNA, 714 bp, Homo sapiens
  misc_feature: GZ8MTXP01BODQ2.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaattaaacgtacttaatttaaattggtatcagacaacgaaaccgaagggaaacgcccctaagcctacctgattctaatcgtaccttactttcccgtagttttacgacgtaaaacggggttcgggggttacccgtacgtaaaggggttccgaagggttcgggactaaggtggggaattccgggtaggggaacctagttactttccaaccttcctacctaaccgtacgtcccggtcgttccgtcgacctaaaccgtagtaaacgtacttttaccgactaaacttactactacgtacctaacgtaacgttaaccttaaccgaaccggttccccgacccccccgtaattcccgtaacccggttaccggtacccggaaacgggtaccgaacgaacgtaagggaaacgtaaacgttaaaccgtaaacggtcggttacggttccgttacgaaccctaacctcttacggttcttaccttccgttaaccgtttccccg

SEQ ID NO: 307836 - DNA, 667 bp, Homo sapiens
  misc_feature: GZ8MTXP01BVQA4.22.65.F10.1.454.CMB.2.raw
  modified_base (274)..(274): a, c, t, g, unknown or other
  misc_feature (274)..(274): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggacaagtcagagcaataaacgtacttaatttaaatggtatcagacaagaaaccagggaacncccctaagctcctgatctagtgcttacttcctagtttcgacgtaaaggtcggggttacccctagtaaagggtttcaaggttcgggactaggtcggattcgtagggaactaggtactttccacttctacacctagtcccgcggtctcgacctaacctgtaaagtctttacgacctaaacttactaacttacgtaccaaacgtaacggtaacctttacgaaccggttccccgacccccccggtataccccgtaacccgtttccgggaacccgaaacggggtaccaaaccggtaacggttaacgggaaacgttaaacgttaaaaccggaacgttcggttcgggttacttcggtaaccacccgtaacttcgtcttaccttccgttaacgtttccccg

SEQ ID NO: 307837 - DNA, 677 bp, Homo sapiens
  misc_feature: GZ8MTXP01CZ3TE.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagacataacgtactaatttaaattggtatcagcaagaaaccgaagggaaacgccccctaagctcctgatctatcgacttacttcctagttttagacgtaaagggttcgggggtaccccgtagtaaagggtttcaagggttcggacgtaagggttgggaactttccggttagggggaacctaaggtacttttaccaacttcctaccgaacctacgtcccgtacggtctacggacctaaccgtagaaacgtactttacgactaacttactactacgtaccaactacgtaccttaacaccgttcccgaccccccgtataccctacccgttccggaaccgaaacgggaccgtaacggaacgttagggaaacgtaaacgttaaaaccgtaacgtacggttacggttccgttacggaacctacctaacgttcttcgttccttaacgttaacgtttccccg

SEQ ID NO: 307838 - DNA, 654 bp, Homo sapiens
  misc_feature: GZ8MTXP01A6P2R.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccacctgccgggacaagtcagagcaataaacgtacttatttaaatggtatcagcaagaaaccgagggaaacgcccctaagctcctgatctatgaccttacttccgtagtttcgacgtaaagggttcgggggtacccctagaaagggttccaaggttcggactaaggtggtaattccgtagggggaacctaaggtacttttacccgaacctttcctacgaccctacgtcccggtcggttcctacgtacctaaaccgtagtaaacggttactttaccgacctaaaccttacctactacgtacaacgtaacgtaaccttaacgaccgtcccgaccccccgattacccgtaccgttccggaccgaacgggaccacggaacgtaggaagtaaacttaaacgtaacgtggttcggcttacgaactacctaactcgtcgttccttcgttaacttcccg

SEQ ID NO: 307839 - DNA, 674 bp, Homo sapiens
  misc_feature: GZ8MTXP01DBSH9.22.65.F10.1.454.CMB.2.raw
  modified_base (190)..(190): a, c, t, g, unknown or other
  misc_feature (190)..(190): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatcgtgtagganacagatcacatccactggaccggcaagtcagagacaataaacgtattaatttaaagtgtatnagacaagaaaccgaaggaaacncccctaagtcctacctgaactctatcgtacttacttcctaggtttcgaacgtaaagggttccgggtaccctagaaagggtttccaaggtggctaggtggactcgtagggaactgtactttaccacttctaccacgtactccgtacgttcacgacctaaccgtaggtaacgtacttttcgaaccttaaaccttacgtacgttacgttaacaaacgtaacgtaaccttaccgtaccgttaccccggacccccctacgttacccgtaaacccgttcccggtaaaccggaacggggtaacccaacggtaaccgtagggaaacgttaaacgttaaaacccgtaaagtcggttcggcttacggaaccctactaacgttcttcgttaccttccttaacgtttccccg

SEQ ID NO: 307840 - DNA, 754 bp, Homo sapiens
  misc_feature: GZ8MTXP01CKYZE.22.65.F10.1.454.CMB.2.raw
  modified_base (222)..(222): a, c, t, g, unknown or other
  misc_feature (222)..(222): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccatccctccctgtctgcatctggtaggagacagacgtcacatccaccgtggccgganaagtcagacgactaataacgtacttaatttaaagtggtactcgaagacgaaacggaaaccgtagggaaacctaccccgtaagccttctagtactctatcgtaccttacgttaccgtagtttcgaacggtaaacgggttcggggtacccctaggtaaacgggttcgaaggtcgggacgtagggtacggtaagttcgggtaagggtaacctaaaggtttaccttttaccgacccttccctaccgtaaacccgcgttccccgggtacggttacctacgggtaaccctaaacgtacggtaaacgtttaccttaccgtaaccttaaaccgttacctacgtactaaccgaaacgtacgttaacccgtaccgacccgttaccccgaccccccgtattaccccgtacccggttaccggaacccggaacgggtaaccgaaccggtaacgtacgggaaacgttaaaccggttaaacgtaacggtcggttacgcgttaccaaccctactaacgttcctcgttccttaacgttaaccttccccg

SEQ ID NO: 307841 - DNA, 660 bp, Homo sapiens
  misc_feature: GZ8MTXP01C5QC8.22.65.F10.1.454.CMB.2.raw
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccacctggccgganaagtcagagactaataacgtataatttaaagttggtatcagacaagaaaccgagggaacncccctaagctcctagatctatcgtaccttacttccgtagtttcgacgtaaagggttcgggggtaccctagtaagggtttcaggtcggacaggtggatcgagggaacagtacttaccactcctcgaacctacgtcccgtcgtctacggacaaccgtgaaatactttcgactaacttactactagtaccaacgtacgtaaccttacaccgtcccgtacccccgattccgtacccgttacggaccgtaaacggggacctaacgtaaccggttaggaaacgtaaacgttaaaaccgtacgttcgggttacgggttccttacgggaaccctaacccttaacggtttccttccggtttaccctttaacccgttaacccgttttcccccg

SEQ ID NO: 307842 - DNA, 706 bp, Homo sapiens
  misc_feature: GZ8MTXP01B77N5.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgganaagtcagagcataacgtacttaatttaaatggtatcagacaagaaaccgagggaaacgcccctaaagcctacctgattctaatcgtacctttacttacctaggttttcgacgtaaaggggttccgggggtacccctagtaaagggtttcaagggttggacaggtggattcggtaggggaactaggtactttccgaaccttcctacaacccgtacgtcccggtcgtcgtacgacctaaaccgtagtaaacggttactttaccggaacctaaaccttaaccttaacttacgtaaccaaacggtaacgtaaccgtttaaccgaccggttaccccgaccccccccgtaagtaccccgtaacccgttccggtaacccggaaacgggtaccacggtaaccgtagggttaacgtaaacgttaaaccgtaaacgttcgggttacggttcttacggtaacctaccgtaacttctcggttaccttcgttaacctttccccg

SEQ ID NO: 307843 - DNA, 733 bp, Homo sapiens
  misc_feature: GZ8MTXP01ENQHM.22.65.F10.1.454.CMB.2.raw
  modified_base (219)..(219): a, c, t, g, unknown or other
  misc_feature (219)..(219): n is a, c, g, or t
  modified_base (285)..(285): a, c, t, g, unknown or other
  misc_feature (285)..(285): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaaccatcaccgtggccggganaagtcaagagactaataaacgtattaatttaaatggtaatcaagacaaagaaaccgaagggaaacnccccctaaagtcctccgtagacttactagtcgtacttacttccgtaggtttcgaacgtaaacgggtcggggttaccctagtaaaggtttcaaggttcggactaggtcggtataccgtagggaaccagttaaactttcccacttcctaccacccgtacgtcccgtcggtactacggactaaccgtagtaacgttactttacgacttaacttacgtacttacgtaacaactacgtaccgttaaccaccggtaccccgtaccccccgtacgtaccccgtacccgttaccgggaaacccgtaaacggggaccctaaacgggtaaccgtaagggttaaacggtaaacgtttaaaaccggtaacggttcggttaacgggttccttaaccggtaaccctaaccccgttaatttcccggttaccgtttaccctttccgttaaccgttttcccccgg

SEQ ID NO: 307844 - DNA, 621 bp, Homo sapiens
  misc_feature: GZ8MTXP01A2EGM.22.65.F10.1.454.CMB.2.raw
  modified_base (274)..(274): a, c, t, g, unknown or other
  misc_feature (274)..(274): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggacaagtcagagcaataaacgtactaatttaaatggtatcagacaagaaaccagggaaacncccctaagctcctgatctatcgtactacttccagtttgacgtaaagggtcgggtaccctagaaaggttcagtgganagtggatctagggaacagtactttcacctctacacctactccgcgttcncgactaaccgtagtaaacgtactttacgactaaacttactaacttataccaaacgtaacgtacttaacgacgttacccgaccccccgatcctaaccgttcgtaccgaaacgggacaacggaacgtacggaagtaaacgttaaacgaacgttacggttacgggttccttaacggaacctaacccgtaacttccgttcgttaccctttccttaacgtttccccg

SEQ ID NO: 307845 - DNA, 754 bp, Homo sapiens
  misc_feature: GZ8MTXP01AWF88.22.65.F10.1.454.CMB.2.raw
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
tcagacatacgcgtcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctccactcctccctgtctgcatcgtgtaggagacagacgtcaccatccacctcgccgtgacaagtcagacgactaaattaacgttacttaatttaaagtggtacacgaagacaaacggaaaaccgtaagggaaacctccccgttaaagccttaccgtagtacttacttacgtcgtacttaccgtttctaggtttcggaacggtaacgggttcgggtacctagtacggttccnggtggtctaggtcggtaacttacgggngggtaaactacggttactttccaacttcccaccgtaaaccgtcgtcccgggtacggttacacggtaacctaaacggttaggtaaacgtttaccgtttaccgaaacttaaacctttacgtacttaaccggtaacaaacgttaacggttaacccttaaccgacccggggttacccccgaccccgttacttacccggtacccggtacccgggaacccggtaaacggggaccaaacgggtacggttaaacggtaaaccgttaaacgttaaaccggacgttgggttcgaccgtaactacccgtaacttacgtccttacgttaacttccttaaccccg

SEQ ID NO: 307846 - DNA, 602 bp, Homo sapiens
  misc_feature: GZ8MTXP01EIAER.22.65.F10.1.454.CMB.2.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgccggnaagtcagancaataacgtactaatttaaatggtatcagacaagaaaccagggaaacncccctaagctccagatctatcgtacttacttcctagtttcgacgtaaagggttcggggtccctagaaggttcaggtggctaaggtggatcgtgggaactagtacttttccacttcctacaccacgtcccgtcgtctcgactaactagaacgttacttcgactaaacttactaacgtactacaaacgtagtacctttaacaccggtcccgacccccgtatcctacccgttcggaacccgaaacgggaccaacggtaacgtagggaagtaaacgttaaacgaactggttacggcttagaaccactaactctacgttacttcgttaacgttccc

SEQ ID NO: 307847 - DNA, 669 bp, Homo sapiens
  misc_feature: GZ8MTXP01B70SX.22.65.F10.1.454.CMB.2.raw
  modified_base (279)..(279): a, c, t, g, unknown or other
  misc_feature (279)..(279): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccggacaagtcagagcaattaaacgtacttaatttaaattggtatcgagacaagaaaccgaagggaaaccncccctaaagcctccgtgatctatcgtcttacttccgtagtttcgacgtaaagggttcggggtacccctagtaaggttcaggttggactaggtaggatcgtagggaactagtactttcactctacacctacgtccggtcgtctacgactaacctagaaacgttactttacgacttaaacttactacgtacgtaaccaaacgtacgtaacctttaccgaccgttcccgaccccccgtatacccgtaacccgttccggaacccgtaaacgggaacctaaccggtaaccgtaagggttaaacggttaaacgttaaaccggtaaacgttcggttacgggcttaccggaacctaaccgtaattcccgtcgttaccttaaccgttaacgtttccccg

SEQ ID NO: 307848 - DNA, 658 bp, Homo sapiens
  misc_feature: GZ8MTXP01AZDLL.22.65.F10.1.454.CMB.2.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
  modified_base (620)..(620): a, c, t, g, unknown or other
  misc_feature (620)..(620): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtccaccatccaccgtggccggganaagtcagagctaattaacgtacttaatttaaatggtatcagacaacgaaaccgagggaaacncccctaagctcctgatctatcgtacttacttcgtagtttcgacgtaaagggtcgggtaccgtagaaaggtttcaggtggacgtaggtaggacttacggtaggggaactaggttaacttttccaccttctaccaaccgtacgttccccgggtcggttcctacggacctaaaccgttaggtaaacgttactttaccgtactaaaccttactacgtacgtaccaaacggattaacctacgtaccgtacccgcccccgtactacctaccgttccggaaccgaaacgggaccaacggtaacgtagggaaacgttaaacgttaaacggtacgtaggcgttcgnaaccactaacgttcgtacttcttaacttcgtttccccg

SEQ ID NO: 307849 - DNA, 680 bp, Homo sapiens
  misc_feature: GZ8MTXP01CAONB.22.65.F10.1.454.CMB.2.raw
  modified_base (296)..(296): a, c, t, g, unknown or other
  misc_feature (296)..(296): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccatccctccctgtctgcatcgtaggtaggagacagacgtccaaccatccaccgtggaccggacaagtcaagagactaattaaacgttacttaatttaaatggtatacagacaaagaaaccgaagggaaccncccctaagcctcctagatctatcgaccttacttctaggtttacgacgtaaacgggttccggggtacccttaggtaaaggttcaagggttcggactaggtcgactcggtagggaactactactttccactctaccgacctcgtccgtcgtactcgacctaacgtagtaacttacgttacgtactaaccttactactacgtacaacggtacttaccgtaccgaccgttaccccgaccccctagtaccgtacccgttaccgggaacccgaaacgggtacccgaacgtaaccggtaacggttaacgtaaaccgttaaaacgggtaactggttacgggcttacggaacctaccgtaacttcttcgttacctttcgttaacctttccccg

SEQ ID NO: 307850 - DNA, 641 bp, Homo sapiens
  misc_feature: GZ8MTXP01B69S9.22.65.F10.1.454.CMB.2.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (332)..(332): a, c, t, g, unknown or other
  misc_feature (332)..(332): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcacatcacctgccgganaagtcagancaataacgtacttaatttaaagtgtatcagcaagaaaccgagggaacncccctaagctaccngatctatgacttactctagtttcgacgtaaggtcgggtcccgtanaaggttcaggtggctaggtgacgtcgacgggaatagtactttcacttacctcaaccgtcgtcccggtacgtcgtacgacctaaccgtagtaacgtacgtttaccgtaactaacttactactacgtaccaaacgtacgtaccttaaccgaccgtacccgtacccccccgtagtaccccgtacccgttaccggtacccggaacggtaaccgacgtaacggtaggttaaacgtaaacgttaaaccgtaaacgtggttaccgcgttccgaacctactaacgttcttcgttaccttaaccttaacgtttccccg

SEQ ID NO: 307851 - DNA, 551 bp, Homo sapiens
  misc_feature: GZ8MTXP01APSO7.22.65.F10.1.454.CMB.2.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaatggtatcagcagaaaccaggaancccctaagctctgatctatgctactccagtttnctaaagtcgggtccgtnaaggttcagtggcagtggatcgtgggaacagtatttcactctacactactccgcgtctgaccaaccgtagtacttacgctacttacttactagtacacaacgacgttaccacgccgtcccccacctctacccgttacggaccgaacggacgtaacgacgtaacggacgaaagtaaacgttaaacgtcgttacggcgttcacgaacctgtaacctgtcttacctaattccgttccccg

SEQ ID NO: 307852 - DNA, 669 bp, Homo sapiens
  misc_feature: GZ8MTXP01CHTCB.22.65.F10.1.454.CMB.2.raw
  modified_base (221)..(221): a, c, t, g, unknown or other
  misc_feature (221)..(221): n is a, c, g, or t
  modified_base (384)..(384): a, c, t, g, unknown or other
  misc_feature (384)..(384): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccatcctccctgtctgcatctgtaggagacagagtcaccatccaccgtcggccgganaagtcagagactaattaaacgtactttaattttaaagttggaatcgaagaacaacggaaaaccgaggggaaaacctccccctaagccttccgtagacttactatcgaccttacttccgtagtttcgaacgtaacgggttccgggggtccctagaacgggtttnacggtggactagggtggactacgagggaactagttcttacacgtcctacaaccgtcgtccgtcggtactcgaccgtaaccgtgtaaacgttctttacgaccttaacttacttaactagtaccaaacgtacgtaaccgttccaccggtccccacccccgtatcccgtaccgtaccggaccgtaacgggactacggaagtacggaaagtaaacgttaaacgtaacgttggacggttacgttaccgtaacaccttaacgttctacgttaccttcgaaccctttccccg

SEQ ID NO: 307853 - DNA, 620 bp, Homo sapiens
  misc_feature: GZ8MTXP01ECAQW.22.65.F10.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (505)..(505): a, c, t, g, unknown or other
  misc_feature (505)..(505): n is a, c, g, or t
  modified_base (585)..(585): a, c, t, g, unknown or other
  misc_feature (585)..(585): n is a, c, g, or t
tcagacatacgcgtcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctccactccctccctgtctgctatcgtggtagganacagatcaccatccacgtgccggnaagtcaganactaattaaacgtacttaatttaaagtggtaatcagacgaaacgaaaccgaaggaaaccgcccctaaagcctccgtagtacttctatcgtaccttaacttccgtaggtttacgacgtaacggttcggggtaccctagtagttcaggtcggagagtcgatcggtagggtaacngttacttcccactccgtaccnctacgtcccgcgtctagccaacgtataacgttacttaccaacttaacttactacgtactaacaacgtacgtactaccgccncccgccccgtatcccgaccgtcggaccgaaggcctacggaagtacggaaataaacgttaaacgcgtagttcgttcttacncaactcttctacgttccttaacgttccttaacccg

SEQ ID NO: 307854 - DNA, 721 bp, Homo sapiens
  misc_feature: GZ8MTXP01DACAP.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatcgtgtaggagacagagtcacatcacctgccgggacaagtcagagacaattaaacgtacttaatttaaattggtaatcgaagacaagaaacccgaaggggaaacgccccctaagcctcctagactctatcgtacttacttcctaggtttcgacgtaaaggttcggggtccctagaaggtttcgaggtggactaggtagacgtccgtaggggaactaaggttacttttcccaacctcctaccgtaacccgtacgtcccggtcggttacctcggaaccctaacccggttaaggtaaacgttaccgttttaccgacccttaaactttaacccttaacgttaccgtaacctaaacggtaaacggttaacccttaaccgtaccggttcccccggaacccccccgttagtaccccgttaacccggttccgggaaacccgaacggggaccctaacggtaacgtacgggaaagtaacgttaaaccgaacgttcggttacgggcttacgaacctacgtaacttcgtcttaccttcttaaccgtttccccg

SEQ ID NO: 307855 - DNA, 747 bp, Homo sapiens
  misc_feature: GZ8MTXP01CVK0S.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatccacctggccgggacaagtcagagactaattaacgtaacttatttaaagtggtaatcaagacaagaaaaccgaaggggaaactccccctaagcctacctagtacttctatcgtaccttacgttcctaggtttacgacgtaaacggggttccgggggttacccctaagtaacggggtttcaaggggttggacgtagggtacggacttaccgggtaggggaacctaggtttattttcccaacttcctacccgtaacacccgttcccggtcggtaccgtcggacctaaccgtagtaacgttactttacgaccttaacttacgtactacgtaaccaaacgtacgtaccttaaccgtaccggtaccccgtaccccccgtacttcccgtaaccccggttaccggaacccggaaacgggtacccgtaaaccggtaacggtaacgggttaaacgtaaacgtttaaaccgtaaacggttcggttacgggccttaccggaaccctaccgtaactttccgttacgttaccctttccgttaacccgtttcccccg

SEQ ID NO: 307856 - DNA, 738 bp, Homo sapiens
  misc_feature: GZ8MTXP01BN1A6.22.65.F10.1.454.CMB.2.raw
  modified_base (217)..(217): a, c, t, g, unknown or other
  misc_feature (217)..(217): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaccgtggccgganaagtcagagcaacttaaacgttacttaatttaaagttggtaatcgagacaaagaaaccgaagggaaacgccccctaagcctcctagtactcgtatcgcttacttccgtagtttcgacgtaaacgggttcggggttaccccgtagtaaacgggttccaagggttcggacgtaaggtcgggtaattaacccggaggggtaactaaggttacttttacccaccttacgtaccctaaaccgtccgttcccggtcgggttaccttacggacctaaacccgtaggtaaaacgttcgttttaccgaacctttaaaccttaaccttaaccttacgtaaccgtaaaccgtaacggttaacctttaaccgacccggttccccggaaccccccccgttataccccgtaaccccggtttcccgggaacccgtaaacggggtacccaacggtaaccgttaggaaacgttaaacgttaaacgaaccgtggttacgcttgaaccctcaattcgtcttacctcgttaactttccccg

SEQ ID NO: 307857 - DNA, 677 bp, Homo sapiens
  misc_feature: GZ8MTXP01C8LJI.22.65.F10.1.454.CMB.2.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcaccgtgccggacaagtcagagacaattaaacgtacttaatttaaattggtaatcagacaagaaaccaagggaacncccctaagctccagatctatcgacttacttccgtagttttcgacgtaaagggttcgggggtacccctagaaagggttcaggttggactaggtcggattccggtaggggaactagtactttccaccttctacacctactcccgtcgtccttcgacctaaaccgttagtaaacggttacttttaccgaccttaaaccttaactacttacgtaaccaaacgtaacgtaacctttaaccgaccgtacccgacccccccgtataccctacccgttaccgggacccgaacgggaacccgacggtaaccgtagggaaacgtaaacgttaaacgaaccgttcggttacggttccttacggaaccctaacctcttaccgttcgttcctttccttaaccgttttccccg

SEQ ID NO: 307858 - DNA, 665 bp, Homo sapiens
  misc_feature: GZ8MTXP01AJHU6.22.65.F10.1.454.CMB.2.raw
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccaccgtgccggcaagtcagagcaataacgtactatttaatgatcagcaagaacaggaacncccaagctcnatctatgctacttctagttgacgtaacggtcgggtaccctataaggttcaggtcggacgtaggtacggattcccggtaggggtaacctaggttactttaccaaccttccgtaaccgaacctacgtccccgtcggggttacctacgtaaccgtaaccgttacggtaaacgtacgtttaccgaaccttaaacttaacctacgtacgtaccaaccgtacggtaaacctttaccgacccgtacccgaccccccgtatacccgttaccgtacccggtccgaaacgggtaccgaacggtaacgtaacgggaagtaaacgttaaaccgaacgttcggttacgggttcttaccgaacctacgtaacttcgtcgttaccttaacgttaacctttccccg

SEQ ID NO: 307859 - DNA, 702 bp, Homo sapiens
  misc_feature: GZ8MTXP01CGHQU.22.65.F10.1.454.CMB.2.raw
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (586)..(586): a, c, t, g, unknown or other
  misc_feature (586)..(586): n is a, c, g, or t
  modified_base (667)..(667): a, c, t, g, unknown or other
  misc_feature (667)..(667): n is a, c, g, or t
  modified_base (694)..(694): a, c, t, g, unknown or other
  misc_feature (694)..(694): n is a, c, g, or t
tcagacatacgcgtcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctccactccctccctgtctgcatcgtagtaggagacagacgtccacactccaccgtcggccgganaacgtcgaagacgactaataaacgttatttaaatttaaacgtggtancgaacgacgaaagaaaccggtagggaaacctcccctaagtcctctagactttctagtccgtactttacgttccgtagtttcggaaacggtaacggggttccgggtcctaaggtaggttcgaggcgggacgtagggtgtaccgtagggtaaggctaacgtttacctttaccgacctccgtacccgaacgtccgttcccgggtgttacctacgaccgtaacgtagtaaactttcgttaccaaccttaacttacctaacgagtaaccaaaccggtagttaccccttaacgccccgtacccccggtaccccttanacccgttaaccgtcggaaaccgaaacggtccctaaggaaccgtaagttaaacgtaaaccgttaacgtgtcggttcgttacnccaacttacttcgtcttcgttacttcnccgtcccg

SEQ ID NO: 307860 - DNA, 740 bp, Homo sapiens
  misc_feature: GZ8MTXP01D6JV3.22.65.F10.1.454.CMB.2.raw
  modified_base (223)..(223): a, c, t, g, unknown or other
  misc_feature (223)..(223): n is a, c, g, or t
  modified_base (295)..(295): a, c, t, g, unknown or other
  misc_feature (295)..(295): n is a, c, g, or t
tcagacatacgcgtcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtcctccactccctccctgtctgcattcgtggtaggagacagagtccacatcaccgtgccggnaagtcagagacaattaaacgtattaatttaaagttggtaatcgaagacaaacggaaacccgaagggaaaccnccccctaagcctaccgagtactctatcgtacttacttctaggtttcgacgtaacgggttcgggtaccctagtaacgttcgaggtcggagtaggtggacttaccgggagggaacctaagtttaccttttaccaaccgttcctacgaacccttccgttcccgggtcgttcgtacgacctaaccgtagtaaacgttacgtttaccacttaaccttacttacgttacgtacctaacggtaacgttaaccgttaaccgtacccgtccccgtaccccccgtacttacccgtaacccgttccgggaaccgtaaacgggaccgtaacggtaaccgttaagggaaacgtttaaaccgttaaacggtaacggttcggttacggttacccggttacgaaccccttaaccgttaacttccgttacggtttccctttaacccgttccctttcccccgg

SEQ ID NO: 307861 - DNA, 691 bp, Homo sapiens
  misc_feature: GZ8MTXP01CLID0.22.65.F10.1.454.CMB.2.raw
tcagacatacgcgtcacgaccggtgctcgatttagctacgctctaagggggagtcagtctcagtcaggacacagcatggacatgagggtccccgctcagctccgtggggctcctgctactctggctccgaggtgccagatgtgacatccagatcgacccagtctccatccctccctgtctgacatcgtaggtaggagacgaagagtccaaccgtatccaccgtgggacccggactaaggtccaagagactaaagttaaaccgtattaatttaaatggtatcagacaagaaacgagggaactccctaagctctagatctatgtaccttacttcgtagtttgaacgtaagggttcgggttacccgtagtaaagggttaacgcggtacgaggttcggtagtcgtaaacgggaactaaggtactttaccgactttaccaccgaacccgtgccccgggtcgttagtccaaccggtaaccttagaaacgttcgtttaacgacttaaaccttacgttactcgtacgaaactacgtacctttacgaccgttaccccgacccccggtactcccgtaaccgttacccgaacgtaacgggacctaaacgtaccgtaaggtaattaaacggtaaacgccgttaggtggacccttcggacctaacactttggtcctttagttacctcgttttaaccccgtcccg

SEQ ID NO: 307862 - DNA, 743 bp, Homo sapiens
  misc_feature: GZ8MTXP01D518J.22.65.F10.1.454.CMB.2.raw
  modified_base (221)..(221): a, c, t, g, unknown or other
  misc_feature (221)..(221): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccactcctccctgtctgcatctggtaggagacagagtcaccatccaccgtggccgganaagtcagagactaattaaacgtattaatttaaattggtaatcaagacgaaggaaaacccgaagggaaaccaccccctaaagtcctaccgtgacttctaatcgtaccgttaactttaccgtagtttacgacgtaaagggtccggggttacccgtacgtaaggttcctaaggtggactagggtagacttcgggagggtaactaagtacttttcccgaaccttcgtacccgaacccgtacgtacccgtcggtaccgtcgaaccgtaaccgttagtaaacggttactttacgtaacctaaacttaacgtacttaactaccctaaaagtacgttaacccttaaacgacccgttcccggaacccccccctgtaaccccgttaccccgttaccggaacccggtaaaccggtaccgaacggtaaacgtaccggaaagttaaacggttaaaacgtaaccggtttcggacgggttcttcggtaacccacctaacgtttcccttcggtttcctaaccttaaccgttttccccg

SEQ ID NO: 307863 - DNA, 501 bp, Homo sapiens
  misc_feature: GZ8MTXP02HF6WP.22.65.F10.1.454.CMB.2.raw
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
tcagacatacgcgtcacgaccggtgctcgatttagctacgctctaaggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaatggtatcagcagaaaccaggaaacgcccctaagctcctgatctagtnctacttcagtttgacaagtcgggtcctnaaggttcagtggcagtggatcgtgggcagtatttcactctcaccatccgcgtctgcaacctgaagtatttcgctaacttactactgtacaaacagtacttacacgtccgccccccgatccaccgttcgaccaagggacacgactggagtactaaacgactagtcgctgcacatctgtcttacacttcc

SEQ ID NO: 307864 - DNA, 497 bp, Homo sapiens
  misc_feature: GZ8MTXP02JPZHV.22.65.F10.1.454.CMB.2.raw
  modified_base (315)..(315): a, c, t, g, unknown or other
  misc_feature (315)..(315): n is a, c, g, or t
  modified_base (418)..(418): a, c, t, g, unknown or other
  misc_feature (418)..(418): n is a, c, g, or t
  modified_base (488)..(488): a, c, t, g, unknown or other
  misc_feature (488)..(488): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaagcccctaagctcctgatctatgctacttccagtttgcaaagtgggtccctnaaggttcagtggcagtggatcgtgggacagatttcactctcaccatccgcggtctgcaacctgaagattcgctaacttactactgtcaacagacttacagtcncccccggatccaccttcgccaagggacacgactaggagaacttaaacgaactcgtaggctgcaccatctntcttcatcc

SEQ ID NO: 307865 - DNA, 538 bp, Homo sapiens
  misc_feature: GZ8MTXP02HT66V.22.65.F10.1.454.CMB.2.raw
  modified_base (215)..(215): a, c, t, g, unknown or other
  misc_feature (215)..(215): n is a, c, g, or t
  modified_base (319)..(319): a, c, t, g, unknown or other
  misc_feature (319)..(319): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtactattaaattgtatcagcagaaaccagggaaacgcccctaagctcctgatctatgctacttccagtttgacaaagtggggtcctnaaggttcagtggcagtggatcgtgggcagtatttcacttctcacctatccgcgtctgcaacctagaagtatttcgactaacttactactagtacaacaacgtacttacacgtccgaccccccgatacctaccgttcggaccgaacgggacaacgacgtaggacgaaacttaaacgaacgtgtacggctacgaaccacactctagtcttactacttcccg

SEQ ID NO: 307866 - DNA, 497 bp, Homo sapiens
  misc_feature: GZ8MTXP02H06UH.22.65.F10.1.454.CMB.2.raw
  modified_base (318)..(318): a, c, t, g, unknown or other
  misc_feature (318)..(318): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtgggtcccgtnaaaggttcagtggcagtggatctgggcagatttcactctcacatccgcggtctgcaacctgaaagtatttcgctaacttactactgtcaaacagtacttacagtcgccccccgatcacttcgaccaagggacacgactggagacttaaacgaactgtgctgcacatctgtacttcatcc

SEQ ID NO: 307867 - DNA, 493 bp, Homo sapiens
  misc_feature: GZ8MTXP02JD2JP.22.65.F10.1.454.CMB.2.raw
  modified_base (213)..(213): a, c, t, g, unknown or other
  misc_feature (213)..(213): n is a, c, g, or t
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (483)..(483): a, c, t, g, unknown or other
  misc_feature (483)..(483): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactatttaaattggtatcagcagaaaccagggaaancccctaagctcctgatctatgctacttccagtttgcaaagtggggtcctnaaggttcagtgcagtggatctgggcagatttcactctcaccatccgcgtctgcaacctgaagatttcgactaacttactactgtcaaacagtacttacagtcgccccccgatccaccttcggccaagggacacgactggagactaaacgactgtacgctgcacatcngtctcattcc

SEQ ID NO: 307868 - DNA, 512 bp, Homo sapiens
  misc_feature: GZ8MTXP02GA9ZT.22.65.F10.1.454.CMB.2.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (317)..(317): a, c, t, g, unknown or other
  misc_feature (317)..(317): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagngcataacgtactattaatgtatcagcagaaaccaggaaagcccctaagctcctgatctatgctacttccagtttgactaaaggtggggtccctnaaggttcaggtgcagtggatcgtggggacagtatttcactctcaccntccgcgtctgcactgaagntttcgctaacttactactgtcaacagtacttacacgtccgccccccgatcccacgttccggaccaacgggacacgactaggataacttaaaccgaacttcgaggctagcaccactctcgtctctactcc

SEQ ID NO: 307869 - DNA, 608 bp, Homo sapiens
  misc_feature: GZ8MTXP02IYLVT.22.65.F10.1.454.CMB.2.raw
  modified_base (190)..(190): a, c, t, g, unknown or other
  misc_feature (190)..(190): n is a, c, g, or t
  modified_base (274)..(274): a, c, t, g, unknown or other
  misc_feature (274)..(274): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccacatcaccgtggccgggcaagtcagagcaataacgtactaatttaattggtatcagcaagaaaccgagggaaacncccctaagcctctgatctatgccttacttcctagtttcgacgtaaggtccggggtccctagaaggttcaggtggcaggtggatcgtgggacngttacttcactctacacctatccgcgtcncgacacgtagagtacttcgactaacttacactgtacaacgacgtacttaccgacgtaccccgaccccccgtatacccgtaccgttaccggaccgaaacgggaccgaaccggtacgtacgggtaaacgtaaacgttaaaaccggaacgttggtacgggtacttacggaaccgacccgttacttacgtcgtttacctttacgtaccttttccccg

SEQ ID NO: 307870 - DNA, 505 bp, Homo sapiens
  misc_feature: GZ8MTXP02I2OZ5.22.65.F10.1.454.CMB.2.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (412)..(412): a, c, t, g, unknown or other
  misc_feature (412)..(412): n is a, c, g, or t
  modified_base (496)..(496): a, c, t, g, unknown or other
  misc_feature (496)..(496): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaatggtatcagcagaaaccaggaaacncccctaagctcctgatctatgctacttcagtttgcaaagtcgggtccctnaaaggttcagtggcagtggatcgtgggacagtatttcactctcaccatccgcgtctgcaactgaagtcttacgactaacttactactagtacaaanacgtacttacacgtccgacccccgatccaccttcggaccaagggacacgactaggagaactaaacgactgtcgctgcacatctntctcactcc

SEQ ID NO: 307871 - DNA, 531 bp, Homo sapiens
  misc_feature: GZ8MTXP02G0BX7.22.65.F10.1.454.CMB.2.raw
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactatttaaatggtatcagcagaaaccaggaaancccctaagctcctgatctatgctacttccagtttgacaaaggtcggggtccgtacgaaggttcagtggcagtggatcgtgggacagatttcacttctcaccatccgcgtctcgacaacctgaaagtatttcgactaaacttactactgtacaactacgtacttacacgtcgaccccccgatccaaccgttcggaccaagggacaacgactacggaagtaacttaaacgactgtcggactgaacacactctcgtcttcacttccg

SEQ ID NO: 307872 - DNA, 532 bp, Homo sapiens
  misc_feature: GZ8MTXP02HWRJM.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
  modified_base (322)..(322): a, c, t, g, unknown or other
  misc_feature (322)..(322): n is a, c, g, or t
  modified_base (518)..(518): a, c, t, g, unknown or other
  misc_feature (518)..(518): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcataacgtactatttaaattggatcagcagaaaccagggaaacncccctaagctcctgatctatgcctacttccagtttgctaaagtcggggtccctanaaggttcagtggcagtggatcgtgggcagtatttccacttctcactactccgcggtctgcaacctagtaagtactttacgactaaacttactactagtcaaacacgtacttacacgtaccgacccccgatcctaccgttcggaccaagggacacgacgtaggaagactaaacgaaactgacgctagcaacactctntccttctacttccc

SEQ ID NO: 307873 - DNA, 548 bp, Homo sapiens
  misc_feature: GZ8MTXP02IQKS1.22.65.F10.1.454.CMB.2.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatcacctgccggnaagtcagagcataacgtactatttaaatggtatcagcagaaaccaggaaancccctaagctcctgatctatgctacttccagtttgacaaagtcggggtccctgaaaggttcagtggcagtggatcgtggacagtatttcactctcaccatccgcgtctgaccaacctgaagtacttcgactaaacttactacgtactacaaacagtacttacgacgtaccgaccccccgtatcctacccgttacggacccgaacgggacacgaccgtaggaacgtaaactaaaacgtaacgtgtacggctacgccaaccattcctgttccttactactttccccg

SEQ ID NO: 307874 - DNA, 507 bp, Homo sapiens
  misc_feature: GZ8MTXP02F6QBK.22.65.F10.1.454.CMB.2.raw
  modified_base (317)..(317): a, c, t, g, unknown or other
  misc_feature (317)..(317): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactattaaatggtatcagcagaaaccaggaaagcccctaagctcctgatctatgctacttccagtttgcaaaggtcggggtccctnaaaggttcagtggcagtggatcgtgggcagatttcactctcacatccgcggtctgacaacctgaagtatttcgactaacttactactgtacaacagtacttacagtccaccccccgatccaccttcggaccaacgggacacgactggagtactaaacgactgtacggctgcacactctgtcttcacttcc

SEQ ID NO: 307875 - DNA, 505 bp, Homo sapiens
  misc_feature: GZ8MTXP02HSW0Q.22.65.F10.1.454.CMB.2.raw
  modified_base (215)..(215): a, c, t, g, unknown or other
  misc_feature (215)..(215): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaattggtatcagcagaaaccaggaaagcccctaagctcctgatctatgctactccagtttncaaagtgggtccgtnaaaggttcagtggcagtggatcgtgggacagatttcactctcacatccgcggtctgcaacctgaagtatttcgactaacttactactgtacaacagtaacttacacgtacgacccccgatccaccttcggacctaagggacacgactaggagtacttaaacgactgcgactgcacatcagtctacactcc

SEQ ID NO: 307876 - DNA, 500 bp, Homo sapiens
  misc_feature: GZ8MTXP02JVGN1.22.65.F10.1.454.CMB.2.raw
  modified_base (314)..(314): a, c, t, g, unknown or other
  misc_feature (314)..(314): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaagcccctaagctcctgatctatgctacttccagtttgcaagtggggtcctnaaggttcagtgcagtggatcgtgggacagatttcactctcaccatccgcgtctgcaacctgatattcgactaacttactactgtacaacagtactacagtccgccccccgatccaccgttcggaccaagggacacgactcggagtaactaaacgaactgtcggctgcacatctgtcttcattcccg

SEQ ID NO: 307877 - DNA, 499 bp, Homo sapiens
  misc_feature: GZ8MTXP02IZRZH.22.65.F10.1.454.CMB.2.raw
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaacncccctaagcctctgatctatgctacttccagtttgcaaagtggggtcctnaaggttcagtggcaggtggatcgtgggcagatttcactctcaccatccgcgtctgcaacctgaagatttcgctaacttactactgtacaacagacttacacgtcgccccccgatccaccttcggccaacgggacacgactggacgattaaacgaactgtacgctgcacatctgtcttcacttcc

SEQ ID NO: 307878 - DNA, 572 bp, Homo sapiens
  misc_feature: GZ8MTXP02H3EU7.22.65.F10.1.454.CMB.2.raw
  modified_base (189)..(189): a, c, t, g, unknown or other
  misc_feature (189)..(189): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccggcaagtcagagcaataacgtactattaaatgtatcagcaagaaaccaggaaacncccctaagcctcngatctatgctacttctagtttgactaaaggtgggtaccctnaaaggttcagtggcagtggatcgtgggcagtatttcactctcacatccgcgtctgcaacngaagtattcgactaacttctaactgtacaacagtaacttacacgtaccgcccccgtaatcctaacccgttccggacccgaaagggaccaacggacgtaaggacgtaaaacgtttaaaaccggaaacgttacggtacggtccttacggaacccgaacctaattcccttagtttcccttaccttaactttccccg

SEQ ID NO: 307879 - DNA, 503 bp, Homo sapiens
  misc_feature: GZ8MTXP02G3WEC.22.65.F10.1.454.CMB.2.raw
  modified_base (492)..(492): a, c, t, g, unknown or other
  misc_feature (492)..(492): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaattggtatcagcagaaaccaggaaagcccctaagctcctgatctatgctacttccagtttgcaaagtggggtcctcaaggttcagtgcagtggatctgggacagatttcactctcaccatccgcggtctgcaacctgaaagtatttcgactaacttactactgtacaaacagacttacagtcgcccccgatccacttcggaccaagggacacgactaggagacttaaacgaactgtacggctgcacactctntcttcacttcc

SEQ ID NO: 307880 - DNA, 501 bp, Homo sapiens
  misc_feature: GZ8MTXP02HLQAS.22.65.F10.1.454.CMB.2.raw
  modified_base (196)..(196): a, c, t, g, unknown or other
  misc_feature (196)..(196): n is a, c, g, or t
  modified_base (413)..(413): a, c, t, g, unknown or other
  misc_feature (413)..(413): n is a, c, g, or t
tcagacatacgcgtcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcaacaacttagtctggtaccagcagagacctggccaggctcccaggctcctcatctatggtgcttcaccgaggccacgtggtactccccgcaggttcagtcgccagtgggtctggggacaggagttcactctcaccatcagcagcctgcagtctgaagtattttgctactttatactgtacanctaaattataatgacttggttctagatcaccttcggacaagggacacgactaggataacgttaaacgactgagctgcacatctgtctc

SEQ ID NO: 307881 - DNA, 517 bp, Homo sapiens
  misc_feature: GZ8MTXP02H2IN6.22.65.F10.1.454.CMB.2.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacatcacctgccggnaagtcagagcataacgtactattaaattggtatcancagaaacaggaaanccctaagctctgatctatgctacttccagtttgactaaaaggtggggtcccgtagaaaggttcaaggtggcaggtggatcgtgggcagtatttcactctcaccatccgcgtctgcaacctgaagtatttcgactaacttactaactgtacaaacagtacttacagtcccgcccccgatccaccgttcggaccaacgggacacgactaggagaaacttaaacgaactgtacgctgcaccatctgtctcacttcccg

SEQ ID NO: 307882 - DNA, 626 bp, Homo sapiens
  misc_feature: GZ8MTXP02GEQQS.22.65.F10.1.454.CMB.2.raw
  modified_base (262)..(262): a, c, t, g, unknown or other
  misc_feature (262)..(262): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccggcaagtcagagcaataacgtactattaatgtatcagcagaaacaggaaacnccctaagctcctgatctatgctacttccagtttcgactaaaaggtcgggtaccgtctaaaggttcaagtggcagtggatcgtagggacagtatttcactctcacctatccgcggtctgacaaccgtagtaaacgtactttacgactaaacttactactagtacaaacaacgtacttaacacgtacccgacccccccgtaatacccgtaacccgttaccggacccgaaaacggggaaccgaaacggtaaccgttagggaaacgtaaacgtttaaaaacccggaaaacgttcggttacggggaccttacggaacccgaaccgtaacgtttacctacggtttacctttccgtaaaccttttcccccg

SEQ ID NO: 307883 - DNA, 508 bp, Homo sapiens
  misc_feature: GZ8MTXP02JT4UU.22.65.F10.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (251)..(252): a, c, t, g, unknown or other
  misc_feature (251)..(252): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacgatcccaggatgacccagtcgtccagtcctcccgtgtctagcatctgtagganacagagtcaccatcacctgccggnagcgagngcataacgtactattaatgancannagaacgagacgaccacnctctnatntatnctactctagtgacgagtcggtcgtcgtagtgcgngngngtgngtgngngatatctctctcacactcgcgtctcgcactagagtactacgtactactactactactacacacgtactacgtacgtaccgaccccgacctacctaccgtcgacgacgacgacgacgtacgacgtaacgtaacgtacgtacgtcgtcgtcgaacgactacgtctacgtactactactccg

SEQ ID NO: 307884 - DNA, 503 bp, Homo sapiens
  misc_feature: GZ8MTXP02IUMNV.22.65.F10.1.454.CMB.2.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (460)..(460): a, c, t, g, unknown or other
  misc_feature (460)..(460): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactatttaaatggtatcagcagaaaccaggaaancccctaagctccngatctatgctacttccagtttgcaaagtggggtcctcaaggttcagtggcagtggatcgtgggacagatttcactctcaccatccgcggtctgcaacctgaagtatttcgctaacttactactagtacaacagtacttacacgtcgcccccgatccaccttcggaccaaggcacgactgganacttaaacgaactgtacgctgcaccatctagtcttcacttccc

SEQ ID NO: 307885 - DNA, 565 bp, Homo sapiens
  misc_feature: GZ8MTXP02HJK2S.22.65.F10.1.454.CMB.2.raw
  modified_base (318)..(318): a, c, t, g, unknown or other
  misc_feature (318)..(318): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaattggtatcagcagaaaccaggaaacgcccctaagctcctgatctatgctacttccagtttgcaaagtggggtccctnaaaggttcagtggcagtggatcgtgggacagtatttcactctcaccatccgcgtctgcaactgaatacttcgactaaacttactactagtacaaacagtacttacacggtaccgccccccgtaatcctaccgttccggaccgaaacgggaccaacgtaccgtaggaagtaacgttaaaacgaaccgtagtacggtccgtacggaacctaacccgtagttcttacgttcctttacctaactttccccg

SEQ ID NO: 307886 - DNA, 497 bp, Homo sapiens
  misc_feature: GZ8MTXP02GUWAF.22.65.F10.1.454.CMB.2.raw
  modified_base (308)..(308): a, c, t, g, unknown or other
  misc_feature (308)..(308): n is a, c, g, or t
  modified_base (455)..(455): a, c, t, g, unknown or other
  misc_feature (455)..(455): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccggcaagtcagagcataacgtactattaatgatcagcagaaaccaggaaacgcccctaagctcctgatctatgctactcagtttgcaaagtgggtcctnaaaggttcagtgcagtggatctgggacagatttcactctacaccatccgcgtctgcaaccgtgaagatttcgactaaacttactactgtacaacagacttacagtcacccccgatccaccgtcggaccaacgggacacgactcgganaacttaaacgaacttcgagctgaacaccatctgtctcattcc

SEQ ID NO: 307887 - DNA, 574 bp, Homo sapiens
  misc_feature: GZ8MTXP02HY7TW.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancaataacgtactattaaatgtatcagacaagaaaccgaggaacgcccctaagcctctgatctatgctacttcagtttgactaaggtcgggtcctagaaggttcagtggctaggtgatcgtagggacagtactttcactcctacacctacgtccgcgtctacgactaaccgtagaacgtactttacgactaaacttactactagtacaacacgtactacgacgtcccgacccccgatacctaccgtcggaccgaacgggaccgaacgtacgtacggtaaagtaacgttaaaacgacgttacgtacgtacgtacgaaccaccgtaactcgttacgtcctttactaccttcccg

SEQ ID NO: 307888 - DNA, 514 bp, Homo sapiens
  misc_feature: GZ8MTXP02HDX7A.22.65.F10.1.454.CMB.2.raw
  modified_base (214)..(214): a, c, t, g, unknown or other
  misc_feature (214)..(214): n is a, c, g, or t
  modified_base (277)..(277): a, c, t, g, unknown or other
  misc_feature (277)..(277): n is a, c, g, or t
  modified_base (474)..(474): a, c, t, g, unknown or other
  misc_feature (474)..(474): n is a, c, g, or t
  modified_base (504)..(504): a, c, t, g, unknown or other
  misc_feature (504)..(504): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccgggnaagtcagagcataacgtactattaaatgtatcagcagaaaccaggaaacgcccctaagctccngatctatgctacttccagtttgacaaaggtcggggtccctcgaaaggttcagtggcagtggatcgtgggcagtatttcactctcacatccgcggtctgcaacctgtaagtactttcgactaacttactactagtacaaacagtacttacacgtccgacccccgataccaccttcgaccaagggacacgacgtagganaacttaaacgactgtacgctgcacactctntctcactccc

SEQ ID NO: 307889 - DNA, 528 bp, Homo sapiens
  misc_feature: GZ8MTXP02F9X57.22.65.F10.1.454.CMB.2.raw
  modified_base (319)..(319): a, c, t, g, unknown or other
  misc_feature (319)..(319): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaagcccctaagctcctgatctatgctacttccagtttgctaaaggtcggggtcctnaaggttcagtggcagtggatcgtgggacagtatttcactctcaccatccgcgtctcgacaacctgaagtactttcgactaacttactactgtacaaacagtacttacagtccgaccccccgtatcctaccttcggaccaacggggacaacgacgtaggagtaacttaaaacgaactgtacggctagaacacactctgtacttcacttcc

SEQ ID NO: 307890 - DNA, 505 bp, Homo sapiens
  misc_feature: GZ8MTXP02JRVGT.22.65.F10.1.454.CMB.2.raw
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (464)..(464): a, c, t, g, unknown or other
  misc_feature (464)..(464): n is a, c, g, or t
tcagacatacgcgtcacgaccggtgctcgatttagctacgctctaagggggagtcagtctcagtcaggacacagcatggacatgagggtccccgctcagctcctgtggctcctgctactctggctccgaggtgccagatgtgacatccagatgacccagtctccatcctccctgtctgcatctgtaggagacagagtcaccatcacctgccgggcaagtcggagcataacgtactattaaatggtatcagcagaaaccagggaaancccctaagctcctgatctatgctacttccagtttgcaaagtggggtcctnaaggttcagtggcagtggatctggggacagatttcactctcacctatccgcgtctgcaacctgaagtatttcgactaacttactactgtacaacagtacttacacgtcgcccccgatccaccgttcggccaagggacacgactagganacttaaacgactcgtcggctgcaccatctgtctcacttccc

SEQ ID NO: 307891 - DNA, 552 bp, Homo sapiens
  misc_feature: GZ8MTXP02H22OQ.22.65.F10.1.454.CMB.2.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccggganaagtcagagcaataacgtactattaaattggtatcagcagaaaccaggaaacgacccctaagctcctgactctacgctacttcctagtttgacaaaggtcggggtcccgtagtaaggttcagtggcaggtggatcgtgggacaggtactttcacgttctaccaccactcccggcgtctcgactaacgtgaaagtactttcgactaacttactactagtacaacagtaacttacacgtccgacccccgatccaccttcggaccaaggacacgactaggaacgtaagtaaacgaacgtacgtacgctcgacaaccatctcgtcttcctacttcctcccg

SEQ ID NO: 307892 - DNA, 521 bp, Homo sapiens
  misc_feature: GZ8MTXP02GUT7V.22.65.F10.1.454.CMB.2.raw
  modified_base (190)..(190): a, c, t, g, unknown or other
  misc_feature (190)..(190): n is a, c, g, or t
  modified_base (319)..(319): a, c, t, g, unknown or other
  misc_feature (319)..(319): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggcaagtcagagcataacgtactattaaattggatcagcagaaaccaggaaacgcccctaagctcctgatctatgctacttccagtttgacaaagtcggggtcccgtnaaggttcagtggcagtggatcgtgggacagtattcactctcacatccgcgtctgcaactgaagtacttcgactaacttactactgtacaacagtactacacgtccgacccccgtatccaccttcggaccaagggacacgacgtacggagtaacttaaacggaactgtacggactgaactaccattctcgtcttcacttcccg

SEQ ID NO: 307893 - DNA, 507 bp, Homo sapiens
  misc_feature: GZ8MTXP02JKNQ7.22.65.F10.1.454.CMB.2.raw
  modified_base (384)..(384): a, c, t, g, unknown or other
  misc_feature (384)..(384): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccaggaaagcccctaagctcctgatctatgctacttccagtttgcaaaggtcggggtccctcaaggttcagtgcagtggatcgtgggcagatttcactctcaccatccgcgtctgcacctgaagtnttcgactaacttactactgtacaacagacttacacgtcgccccccgatccaccgttcggacctaacgggacacgactaggagaacttaaacgactgtacgctgcacatctagtcttcacttcc

SEQ ID NO: 307894 - DNA, 504 bp, Homo sapiens
  misc_feature: GZ8MTXP02JXJIP.22.65.F10.1.454.CMB.2.raw
  modified_base (265)..(265): a, c, t, g, unknown or other
  misc_feature (265)..(265): n is a, c, g, or t
  modified_base (316)..(316): a, c, t, g, unknown or other
  misc_feature (316)..(316): n is a, c, g, or t
  modified_base (382)..(382): a, c, t, g, unknown or other
  misc_feature (382)..(382): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaancccctaagctcctgatctatgctacttccagtttgcaaagtggggtccctnaaggttcagtggcagtggatcgtgggacagatttcactctcaccatccgcgtctgcaacctgaagntttcgactaacttactactgtacaacagacttacacgtcgccccccgatccaccgttcgaccaagggacacgactaggagacttaaacgactgtacggctgcacatctgtcttacacttccc

SEQ ID NO: 307895 - DNA, 532 bp, Homo sapiens
  misc_feature: GZ8MTXP02FV4BW.22.65.F10.1.454.CMB.2.raw
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaatgtatcagcagaaaccaggaaancccctaagctcctgatctatgctacttccagtttgacaaaggtcggggtcccgtcaaaggttcagtggcagtgggatcgtgggacagtattcactctacactatccgcgtctgacactagaagtacttcgactaacttactactagtacaaacacgtactacacgtccgaccccccgtatacctaccgttccggaccgaaacgggacaacgacgtaggacgtaactaaacgaactgtacgctgaaccactactctcgtctctacttccc

SEQ ID NO: 307896 - DNA, 515 bp, Homo sapiens
  misc_feature: GZ8MTXP02J0OZH.22.65.F10.1.454.CMB.2.raw
  modified_base (320)..(320): a, c, t, g, unknown or other
  misc_feature (320)..(320): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaacgcccctaagctcctgatctatgctacttccagtttgcaaagtggggtcccgtnaaggttcagtggcagtggatcgtgggacagtatttcacttctcaccatcccgcgtctcgcaacctgagtatttcgactaacttactactgtacaacagtactacacgtccgcccccgatccaccttcggaccaagggacacgactaggagaacttaaacgaactgcggctcgcaccatctcgtcttcacttcccg

SEQ ID NO: 307897 - DNA, 500 bp, Homo sapiens
  misc_feature: GZ8MTXP02IMLHW.22.65.F10.1.454.CMB.2.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (489)..(489): a, c, t, g, unknown or other
  misc_feature (489)..(489): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatcacctgccgggnaagtcagagcataacgtactattaatggtatcancagaaacaggaaagccctaagctcctgatctatgctacttccagtttgctaaaggtcggggtccctnaaaggttcagtggcagtggatctggggcagatttcactctcacatcgngctgcactgaanactttcgactaactactactgtacaacagacttacacgtacgccccccgatcaccgttcgacgaacggacacgactggagaacttaaacgaactgtacggctgcaccatctntcttcattccc

SEQ ID NO: 307898 - DNA, 512 bp, Homo sapiens
  misc_feature: GZ8MTXP02HPMJ8.22.65.F10.1.454.CMB.2.raw
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtatattaaatggtatcagcagaaaccaggaaagcccctaagctcctgatctatgctacttccagtttgacaaagtggggtccctnaaggttcagtgcagtggatcgnggggacagtatttcacttctcaccatccgcgtctgcaacctgaagtactttcgactaaacttactactgtacaaacagtacttacacgtccgcccccgatccaccttcggaccaacgggacacgactaggagaacttaaacgaactgtacgctgcacatctgttctctacttcc

SEQ ID NO: 307899 - DNA, 505 bp, Homo sapiens
  misc_feature: GZ8MTXP02JSJ0Y.22.65.F10.1.454.CMB.2.raw
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (494)..(494): a, c, t, g, unknown or other
  misc_feature (494)..(494): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactattaaatggtatcagcagaaaccaggaaagcccctaagctcctgatctatgctacttccagtttgcaaagtggggtccgtnaaggttcagtggcagtggatcgtgggcagatttcactntcaccatccgcggtctgcaacctgaagatttcgactaacttactacttagtcaaacacgacttacagtcgcccccgatccaaccttcggccaagggacacgactggacgtactaaaacgaaactgtggctgcaccatcgtntctcacttccc

SEQ ID NO: 307900 - DNA, 526 bp, Homo sapiens
  misc_feature: GZ8MTXP02G5T68.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaacgcccctaagctctgatctatgctacttccagtttgacaaaggtcggggtccctacaaggttcagtggcagtggatcgtgggacagatttcactctcacctatcccgcggtctcgacaacctgaagtattcgactaacttactactgtacaacagtacttacacgtccgaccccccgatcctaccgttcggaccaagggaccacgtacgtaggaagaacttaaacgaactgtcggctgaacacactctgtcttacacttccc

SEQ ID NO: 307901 - DNA, 501 bp, Homo sapiens
  misc_feature: GZ8MTXP02FX31S.22.65.F10.1.454.CMB.2.raw
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaagcccctaagctcctgatctacgctacttccagtttgcaaagtggggtccctnaaggttcagtggcagtggatctgggacngatttcactctcacatccgcgtctgcaacctgaagatttcgctaacttactactgtacaacagacttacagtcgcccccgatccaccttcggccaagggacacgactggagattaaacgaactgtacggctgcaaccatctgtcttcactcttcccg

SEQ ID NO: 307902 - DNA, 531 bp, Homo sapiens
  misc_feature: GZ8MTXP02GUY0W.22.65.F10.1.454.CMB.2.raw
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (520)..(520): a, c, t, g, unknown or other
  misc_feature (520)..(520): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggnaagtcagncataacgtactatttaaatggtatcagcagaaaccaggaaagcccctaaagctcctgatctaatgctaacttccagtttgacaaaaggtggggtacccgtcaaaggttcaagtggcagtggatctggggacaggaatttcaccttctcaccatcccgcggtctgcaacctgaaagtactttcgactaacttaactactagtacaaacagacttacaacgtcgacccccccatccaccgtcggaccaagggacacgactaggaagaacttaaacgaactgtacgctgaacaccaatctntactcattccc

SEQ ID NO: 307903 - DNA, 525 bp, Homo sapiens
  misc_feature: GZ8MTXP02F6MSO.22.65.F10.1.454.CMB.2.raw
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactattaaatggtatcagcagaaacaggaaanccctaagctcctgatctatgctacttcagtttgcaaaggtcgggtcctnaaggttcagtgcagtgatctgggcngatttcactctcacatccgcgtctgacactgaagtatttcgactaacttactactagtacaaacagtacttacacgttccgaccccccgatccacccttcggaccaaacggggaccacgacgtaggaagtaaacgttaaaacgaacgtcgtacggctagaaccaccactctgtcttcaactttccccg

SEQ ID NO: 307904 - DNA, 562 bp, Homo sapiens
  misc_feature: GZ8MTXP02F32S2.22.65.F10.1.454.CMB.2.raw
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaacncccctaagctcctgatctatgctacttccagtttgacaaaggttcggggtcccgtgaaaggttcagtggcaggtggatcgtgggacagatttcactctcaccatccgcgtctgacacctgaatctttcgctaacttactactagttacaaacagacttacaacgtccgacccccccgtatcctacccttcggacccaaacggggacaacggacctagggaacgtaacgttaaaaccgaacgttaggtacggccgttacggaacctaactacttctcgttccttctactttccccg

SEQ ID NO: 307905 - DNA, 535 bp, Homo sapiens
  misc_feature: GZ8MTXP02JZ44M.22.65.F10.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaancccctaagctcctgatctatgctacttccagtttgcaaagtggggtccctnaaggttcagtggcagtggatcgtgggcagtatttcactctcaccatccgcggtctcgcaacctgaagtattcgactaacttactactgtacaacagacttacacgtaccgacccccgactccacccgttcggacccgaaacgggaccaacggaccgtaggaacgaacgtaaaacgaacgtcgtacggctacgcgacactctacgtcttctacttcccg

SEQ ID NO: 307906 - DNA, 526 bp, Homo sapiens
  misc_feature: GZ8MTXP02HZ2RC.22.65.F10.1.454.CMB.2.raw
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccgggcaagtcagagcataacgtactattaaatgatcagcagaacaggaancccctaagctcngatctatgctacttcagtttgactaaagtggggtaccctnaaggttcagtggcagtggatcgngggacagtatttcactctcaccatcccgnggtctgcaacctgaaagtactttcgactaacttactaactgtaccaanagtacttacacgtcncccccgatccaccgttcgaccaagggacaacgacgtaggaacgtaacttaaaacgaactcgtacggactacgaaccaacactctgtccttactacttcccg

SEQ ID NO: 307907 - DNA, 520 bp, Homo sapiens
  misc_feature: GZ8MTXP02H3JXC.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactatttaaattggtatcagcagaaaccaggaaagcccctaagctcctgatctatgctacttccagtttgctaaagtggggtcccgtcaaaggttcagtggcagtggatctgggcagatttcactctcacatccgcggtctgcaactgaaagtactttcgctaacttactactgtacaaacagtacttacagtcgccccccgatccaccttcggaccaagggacacgactacggaagtaacttaaaacgaaactgtacggctagcaccaatctgtcttctacttccc

SEQ ID NO: 307908 - DNA, 518 bp, Homo sapiens
  misc_feature: GZ8MTXP02FVTTK.22.65.F10.1.454.CMB.2.raw
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaacncccctaagctcctgatctatgctacttcctagtttgactaaaggtcggggtccctnaaggttcagtggcagtggatcgtggggcagatttcactctcaccatccgcgtctgacaacctgaagtctttcgactaacttactactgtacaacagacttacacgtccgacccccgatccaccttcggaccaagggacacgacgtggaagtaactaaacgactgtacgctcgcacactctacgtctctactccc

SEQ ID NO: 307909 - DNA, 496 bp, Homo sapiens
  misc_feature: GZ8MTXP02FQM29.22.65.F10.1.454.CMB.2.raw
  modified_base (267)..(267): a, c, t, g, unknown or other
  misc_feature (267)..(267): n is a, c, g, or t
  modified_base (317)..(317): a, c, t, g, unknown or other
  misc_feature (317)..(317): n is a, c, g, or t
  modified_base (488)..(488): a, c, t, g, unknown or other
  misc_feature (488)..(488): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaancccctaagctcctgatctatgctacttccagtttgcaaagtgggtccgtnaaggttcagtgcagtggatctgggcagatttcactctcaccatccgcggtctgcaacctgaagatttcgactaacttactactagtcaacagacttacacgtcgccccccgatccaccttcgccaagggacacgactggagacttaaacgaactagtggctgcaccatctntctcactc

SEQ ID NO: 307910 - DNA, 535 bp, Homo sapiens
  misc_feature: GZ8MTXP02FVUY8.22.65.F10.1.454.CMB.2.raw
  modified_base (265)..(265): a, c, t, g, unknown or other
  misc_feature (265)..(265): n is a, c, g, or t
  modified_base (486)..(486): a, c, t, g, unknown or other
  misc_feature (486)..(486): n is a, c, g, or t
  modified_base (522)..(522): a, c, t, g, unknown or other
  misc_feature (522)..(522): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaatggtatcagcagaaacaggaaacncccctaagctcctgatctatgctacttcctagtttgacaaaaggttcggggtcccgtagaaaggtttcaggtggcaggtgggatcgtagggacagatttcactctacaccatccgcgtctgacaacctgaagactttcgactaacttactactagtacaaacagtacttacacgtaccgacccccgatccaccgttcgaccgaagggacacgactaggaanaacttaaacgaacgtgtacggctgaacacactcgtntctacacttaccc

SEQ ID NO: 307911 - DNA, 579 bp, Homo sapiens
  misc_feature: GZ8MTXP02IVFRE.22.65.F10.1.454.CMB.2.raw
  modified_base (213)..(213): a, c, t, g, unknown or other
  misc_feature (213)..(213): n is a, c, g, or t
  modified_base (384)..(384): a, c, t, g, unknown or other
  misc_feature (384)..(384): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccggnaagtcagagcataacgtactatttaaattggtatcagcagaaaccagggaacgcccctaagctcctgatctatgctacttccagtttgactaaaggtcggggtccctagaaggtttcaggtggcaggtggattcgtgggacagtatttccacttctcaccatccgcggtcngacactgaatattcgactaaacttactactagtaccaaacagtacttacacgttccgaccccccgtatccacccgttcggaccgaaacgggtaccaaccgtacgtacgggaagtaaacttaaaacggaaacgttcgtacggtaccttacggaaccgaacccgtaacttccgtacgttccttacctactttccccg

SEQ ID NO: 307912 - DNA, 523 bp, Homo sapiens
  misc_feature: GZ8MTXP02GMUUE.22.65.F10.1.454.CMB.2.raw
  modified_base (323)..(323): a, c, t, g, unknown or other
  misc_feature (323)..(323): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaacgcccctaagctcctgatctatgctacttccagtttgacaaaggttcggggtccccgtnaaagggtttcaggtggcagtggatcgtggggcagtatttcactctcaccatccgcggtctgacaacctgaagtactttcgactaacttactactgtacaaacagtacttacacgtcgccccccgatccaccgttcgaccgaaggacacgacgtaggagtaactaaacgacgtgtacggctgcacactctgtctcacttcc

SEQ ID NO: 307913 - DNA, 548 bp, Homo sapiens
  misc_feature: GZ8MTXP02HCEDK.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatggtatcagcagaaaccaggaaacgcccctaagctcctgatctatgctacttccagtttgactaaaggtcggggtccgtacaaaggttcagtggcaggtggatcgtgggcagtatttcactctcaccatccgcgtctgcaaccgtgaagtattcgactaacttactactagtacaaacacgtacttacacgtccgaccccccgatccaccgttcggacccgaaagggacacgacgtacggaatacgttaaaacgaacgttcgtacggcttacggccaccgtacttctacgtcctttacactttcccg

SEQ ID NO: 307914 - DNA, 516 bp, Homo sapiens
  misc_feature: GZ8MTXP02IEOM3.22.65.F10.1.454.CMB.2.raw
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
tcagacatacgcgtcacgaccggtgctcgatttagctacgctctaagggggagtcagtctcagtcaggacacagcatggacatgagggtcccgctcagctcctggggctcctgctactctggctccgaggtgccagatgtgacatccagatgacccagtctccatcctcctgtctgcatctgtaggagacagagtcaccatcacctgccgggcaagtcagagcaataacgtactatttaaattggtatcagcagaaaccagggaaacgcccctaagcctcctgatctatgactactttccagttttgactaaaggtcggggtacccgtgaaaggttcagtggcagtggatcgtgggacagtatttcactctcacatccgcgctgcaactgagtatttcgactaacttactactgtacaacagtacttacacgtccgcccccgatccnccttcggcaacggacacgactagganacttaaacgactcgtacgctcgcaccatctgtcttcacttccc

SEQ ID NO: 307915 - DNA, 551 bp, Homo sapiens
  misc_feature: GZ8MTXP02JXM23.22.65.F10.1.454.CMB.2.raw
  modified_base (271)..(271): a, c, t, g, unknown or other
  misc_feature (271)..(271): n is a, c, g, or t
  modified_base (538)..(538): a, c, t, g, unknown or other
  misc_feature (538)..(538): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggacaagtcagagcaataacgtactatttaaattggtatcagcagaaaccgaggaaacncccctaagctctgatctatgctacttccagtttgactaaggtcgggtccctagaaggttcagtggctagtggatcgtggggactagtatttcactctacaccactccgcggtctgacaaccgtagaacgtacttcgactaacttactactagtacaaacagtacttacgacgtccgaccccccgtatccgtacccgttcggaccgaaggggaccacgtacgtagggaacaagttaaacgaacgtgtacggctcgaactactactctntcttcacttcccg

SEQ ID NO: 307916 - DNA, 520 bp, Homo sapiens
  misc_feature: GZ8MTXP02HJCI4.22.65.F10.1.454.CMB.2.raw
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatgtatcagcagaaaccaggaaacncccctaagctcctgatctatgctacttccagtttgactaaaggtcggggtacccgtacaaaggttcagtggcagtggatcgtgggacagtatttcactctcaccatccgcgtctgcaacctgaagtatttcgactaaacttactactagtacaaacagtacttacacgtccgcccccgatccaccgttcggaccaagggacacggactaggataacttaaacgactcgtacgctgcacactctgtctctacttcc

SEQ ID NO: 307917 - DNA, 562 bp, Homo sapiens
  misc_feature: GZ8MTXP02HRNSA.22.65.F10.1.454.CMB.2.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcaataacgtactattaaattgtatcagacaagaaaccgaggaaacncccctaagcctcctagacttctatcgtacttacttcctagtttcgacgtaaaggtcggggtaccctagaaggttcagtgcagtgatcgagggacagtattcactctcactactccgcgtctcgacacgtagtaagtacttacgactaacttactactagtacaactagtacttacacgtcccgacccccataccaccgttcggacgaacggacaacgacgtacggaagtaaacttaaaacgaactggtacgcgtacgaacctactacttctacgttccttactactttccccg

SEQ ID NO: 307918 - DNA, 553 bp, Homo sapiens
  misc_feature: GZ8MTXP02IQ82W.22.65.F10.1.454.CMB.2.raw
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccgggcaagtcagagcataacgtactaattaaattgtatcagcagaaaccagggaaacgacccctaagctcctagatctatcgcttacttccagtttcgacgtaaaaggtcggggttacccgtagtaaagggtttcaaggttcgggactaggttggggaacttcgttaggggactagtaactttcaaccttctacaccatccgcggtctgcaactagaatctttcactaaactactactatacaaacatacttacgacgtacccgcccccatacctacgttacggacgaaggacacgacgtagaacgacttaaaacgactcgagctancacatctntctctactc

SEQ ID NO: 307919 - DNA, 519 bp, Homo sapiens
  misc_feature: GZ8MTXP02FQSCY.22.65.F10.1.454.CMB.2.raw
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagcctccatcctccctgtctgcatctgtaggagacagagtcaccatcacctgccggcaagtcagagcataacgtactattaaatgatcagcagaaaccaggaaacncccctaagctcctgatctatgctacttccagtttgactaaaggtcgggtccctnaaggttcagtgcagtggatcgtgggacagatttcactctacaccatccgcggtctgacaacctgaagtctttacgactaacttactactagtacaaactacacttacacgtccgccccccgatccaccgttcggaccaacgggacaacgactaggaataacttaaacgaactgtacggctcgcacactctctctctacttcc

SEQ ID NO: 307920 - DNA, 571 bp, Homo sapiens
  misc_feature: GZ8MTXP02HXW12.22.65.F10.1.454.CMB.2.raw
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccggcaagtcagagcataacgtactatttaaatgtatcagcagaaaccaggaacncccctaagctcctgatctatgcctacttcctagtttgacgtaaaggttcggggtacccgttacgaaaggttcaggtggacaggtgggatcgtggggactagtactttcacttctcactactccgcgtctgcaacctgaagtatttcgactaacttactactagtacaactacgtacttacacgtcccgacccccgtatacctaccttcggaccgaaacgggaccaacggacgtagggaaacgtaaacttaaaacggaacttcggtacggactcgaacctacctacttctgttccttactactttcccg

SEQ ID NO: 307921 - DNA, 666 bp, Homo sapiens
  misc_feature: GZ8MTXP02HXCME.22.65.F10.1.454.CMB.2.raw
  modified_base (216)..(216): a, c, t, g, unknown or other
  misc_feature (216)..(216): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcaccgtggccgganaagtcagagactaagttaaacgttaacttaatttaaagttggtaatcgaagacaaacgaaaaccggaaggaaccacccctaagcctcgagtattctatcgacttactcgtaggtttgaacgtaaaggtcggggtaccctaggtaacggttcgaaggtggactagggtggaacttcggagggacctagtttaacttccaccttcctaccaaacctcgtcccggtcgtactcgaacctaccgtagtaaacgttactttcgaaccttaaactttactaacgtacgtaaaccaaacgtacgttaaaccttaacgaccggtacccccgacccccgtatacccgtacccggttacggaaccgaacgggaaccaccgtaacggtacggaaacgtaaactaaaacggcgtacgcggtacacggaacccaactactccgtgttaccttactactccccg

SEQ ID NO: 307922 - DNA, 599 bp, Homo sapiens
  misc_feature: GZ8MTXP02JPL2M.22.65.F10.1.454.CMB.2.raw
  modified_base (190)..(190): a, c, t, g, unknown or other
  misc_feature (190)..(190): n is a, c, g, or t
  modified_base (255)..(255): a, c, t, g, unknown or other
  misc_feature (255)..(255): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (405)..(405): a, c, t, g, unknown or other
  misc_feature (405)..(405): n is a, c, g, or t
  modified_base (448)..(448): a, c, t, g, unknown or other
  misc_feature (448)..(448): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccgggcaagtcagagcaataacgtattaatttaaatggtatcganacaacgaacggaaggaaccctacctacgtcctacgtagacttactagcgtacttactcgttagttcaaggtacggtccggtacctagtagtcgaggngngaggtagtcgtcggagacgtattactacacctctaccactcgtccgtcgtnaccgactacgtagacttcgttacacttaactctagtcctaaanaacgtacttactacgtacccggaccccctacccattaccccgtaccggtaccggaaaccgaacggtacctacgtaggacggtaaactaaacggttaaaccgcggttcgacgcacgaacctacttcgttctacgttacctacgtccctcccg

SEQ ID NO: 307923 - DNA, 516 bp, Homo sapiens
  misc_feature: GZ8MTXP02I9EOP.22.65.F10.1.454.CMB.2.raw
  modified_base (315)..(315): a, c, t, g, unknown or other
  misc_feature (315)..(315): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccggcaagtcagagcataacgtactattaaatgtatcagcagaaaccagggaaacgcccctaagctcctgatctatgctacttcagtttgcgaaagtcgggtccgtnaaggttcagtgcagtggatcgtgggacagtatttcactctcaccatccgcggtctcgcaacctgaagtattcgactaacttactactgtacaaactagtacttacacgtccacccccgtatccaccgttcgaccaacgggacacgactggagtactaaacgactgtacggctcgaacactactctcgtcttactacttccg

SEQ ID NO: 307924 - DNA, 501 bp, Homo sapiens
  misc_feature: GZ8MTXP02GG8WX.22.65.F10.1.454.CMB.2.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactatttaaattggtatcagcagaaaccaggaaancccctaagctcctgatctatgctacttccagtttgcaaaggtggggtccctnaaggttcagtgcagtgatcgtgggcagtattcactctcaccatccgcggtctgcaacctgaagatttcgactaacttactactgtcaaacagtactacacgtccgaccccccgatccaccttcggaccaagggacacgactggagactaaacgactgtacgctgcaccatctgtctcacttcc

SEQ ID NO: 307925 - DNA, 527 bp, Homo sapiens
  misc_feature: GZ8MTXP02HH6I4.22.65.F10.1.454.CMB.2.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtactatttaaatggtatcagcagaaaccaggaaacncccctaagctcctgatctatgctacttccagtttgacgtaaaggtcggggtccctagaaaggttcaggtggcaggtggatcgtagggctagtatttcactctcacctatccgcgtctgcaacctgaagtacttcgactaacttactactgtacaaacagtactacacgtccgacccccgatccaccgttcgaccgaagggacaacgacgtaggaagtaacttaaacgactgtcgctgcacactctgtcttctacttccc

SEQ ID NO: 307926 - DNA, 566 bp, Homo sapiens
  misc_feature: GZ8MTXP02G7PT9.22.65.F10.1.454.CMB.2.raw
  modified_base (265)..(265): a, c, t, g, unknown or other
  misc_feature (265)..(265): n is a, c, g, or t
  modified_base (346)..(346): a, c, t, g, unknown or other
  misc_feature (346)..(346): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaatggtatcagcagaaaccaggaaacncccctaagctctgatctatcgctacttccagtttgactaaaggtcggggtacctcgaaggttcagtggctaggtggatcgngggacagtattcactctcacctactccgcggtctcgacaactagaagtactttcgactaaacttactactagtacaaacagtacttacacgtccgacccccgatcctaccgttcggaccgtaaggaccgacgaacgtacggaagtaaacgttaaaacggaaacgttcgtacggcgtacgaaccgacctaactcgttacgttcctttacctactttccccg

SEQ ID NO: 307927 - DNA, 662 bp, Homo sapiens
  misc_feature: GZ8MTXP02IFSQ1.22.65.F10.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccgcacaagtcagagcaataacgtactatttaatgtatcagcaagaaaccaggaaacncccctaagctccngatctatgctacttcctagtttgacgtaaaggtcggggtaccctagtaaggttccaggtggctaggtggtatcgtggggactaagtactttaccacttcctacacccacgttcccggaccggttcctcggacctaaacccgttaggaaaacgttactttaccgaacccttaaactttaaccttaaccttacggtaccaaacgtaacgtaacctttaaccgaaccgtccccggacccccccgtattaccccgtacccgttaccgggacccgtaaaacggggaaccaaccggacgtacgggaaacgtaaacgttaaaaccggtaaccgttaggtacgaccgtaacgaccgtaacctacttaccgttcgttacctttacttacccg

SEQ ID NO: 307928 - DNA, 535 bp, Homo sapiens
  misc_feature: GZ8MTXP02HBM6P.22.65.F10.1.454.CMB.2.raw
  modified_base (189)..(189): a, c, t, g, unknown or other
  misc_feature (189)..(189): n is a, c, g, or t
  modified_base (319)..(319): a, c, t, g, unknown or other
  misc_feature (319)..(319): n is a, c, g, or t
  modified_base (523)..(523): a, c, t, g, unknown or other
  misc_feature (523)..(523): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccggcaagtcagagcaataacgtactattaaatggtatcagcagaaaccaggaaacgcccctaagctctgatctatgactacttccagtttgacgtaaagtcggggtcctnaaggttcagtgcagtggatctgggacagtatttcactctacaccatccgcggtctgcaacctgaaagtactttacgactaaaccttactactactacaaacacgtaacttacgacgtaccgccccccgatccacgttccggaccgaacgggacaacgaacgtcggaacgaactaaaacggaactcgtcggctacgcacactctntacctcacttcc

SEQ ID NO: 307929 - DNA, 592 bp, Homo sapiens
  misc_feature: GZ8MTXP02JEUVV.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagactcaccatccaccgtcggccgggacaagtcagagacaataacgtattaatttaaatggtatcagacaagaaaccgaagggaaaccgcccctaagcctctgatctatctctacttctagtttcgacgtaaaggttcggggtccctagtaaggttcaggtggcgtaggtggatcggtagggactagtactttcacttctacaacctgtcccgcggtctcgactaaccgtagaacgtcttacgactaacttactactacgtaaccaaacacgttacttaccgacggtccccgacccccgtatcccgtaccgtaccggaaccgaacgggacacgacgtaggaagtaaacgtaaacgacgtgtacggctacgaaccactacttctcgtcttactacttcccg

SEQ ID NO: 307930 - DNA, 606 bp, Homo sapiens
  misc_feature: GZ8MTXP02HXWK3.22.65.F10.1.454.CMB.2.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcactgccggnaagtcagagcaataacgtatatttaaattggancagcaagaaacgaggaaacncccctaagctcnatactatcgacctacttcctagtttcgacgtaaggtcggggtccctagaaggttcaggtcggactaggtggtatcggtagggactagtactttccgactctacacctacgtccgcgtctcgactaacctagtaagtactttacgactaaacctttactacgttacgttacaaacgtacgtaaccttaaccgtacgtaccccgaccccccgtataccctaccgtaccggaccgaaacgggacaacggtacgtaggaaacgtaaacgttaaaacggtaacgtcgtacggtactacgaaccgtactactcttacgtaccttactacttcccg

SEQ ID NO: 307931 - DNA, 512 bp, Homo sapiens
  misc_feature: GZ8MTXP02HBU03.22.65.F10.1.454.CMB.2.raw
  modified_base (190)..(190): a, c, t, g, unknown or other
  misc_feature (190)..(190): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggcaagtcagagcataacgtactattaaattggtatcagcagaaaccaggaaagcccctaagctcctgatctatgctacttccagtttgcaaagtggggtcctcgaaggttcagtggcagtggatcgtgggcagatttcactctcacatccgcgtctgcaacctgaagatttcgactaacttactaactgtacaaacagtaacttacacgttcgaccccccgatccaccttcggaccaaacggggacacgacctggacaacgttaaacgactgtacgctgcacactctctcttcacttcc

SEQ ID NO: 307932 - DNA, 517 bp, Homo sapiens
  misc_feature: GZ8MTXP02IKXH4.22.65.F10.1.454.CMB.2.raw
  modified_base (212)..(212): a, c, t, g, unknown or other
  misc_feature (212)..(212): n is a, c, g, or t
  modified_base (261)..(261): a, c, t, g, unknown or other
  misc_feature (261)..(261): n is a, c, g, or t
  modified_base (430)..(430): a, c, t, g, unknown or other
  misc_feature (430)..(430): n is a, c, g, or t
  modified_base (469)..(469): a, c, t, g, unknown or other
  misc_feature (469)..(469): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactgccggnaagtcagagcataacgtactattaatgtatcagcagaaaccaggaaacnccctaagctcctgatctatgctacttccagtttgctaaagtcggggtcccgtcaaaggttcagtggcagtggatcgtgggacagtatttcactctcaccatccgcggtctgacaacctgaagtatttcgactaaacttactactgtacaaacagtacttacacgtaccnccccccgatccaccttcggaccaagggacacgacagganacgttaaaacgactagtcgctcgaacacactctcgtcttacacttccc

SEQ ID NO: 307933 - DNA, 635 bp, Homo sapiens
  misc_feature: GZ8MTXP02G56YM.22.65.F10.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagancataacgtactattaatggtatcagcagaaaccaggaaacgcccctaagctctgatctatgctacttccagtttgacgtaaaggttcggggtaccccgtagaaaggttcagtggctaggtggatcgtgggacagtactttcacttctacacctactccgcggttctacgacctaaccgtagaaacgtacgtttacgacctaaacttactactacgttaccaaactacgtaccttacgaccgttacccgacccccccgtatacccgtacccgttaccggacccgaaacgggaaccgaaaccgtaccgtagggaaacgtaaacgtttaaaaccggaaaccgttcgggttaacggacttcggaacctaacccgtaacgttaccttacggtttccctttaccaaccgtttcccccg

SEQ ID NO: 307934 - DNA, 575 bp, Homo sapiens
  misc_feature: GZ8MTXP02HYQBT.22.65.F10.1.454.CMB.2.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacctggccggcaagtcagancataacgtatatttaaatggtatcagcaagaaaccgaggaaacncccctaagcctcctagactctatcgcttacttcctagtttgacgtaaaggtcggggtccctagaaggttcagtggactaggtggatcgagggacagtatttcacttctccaactctcccgcggtctcgacaacctgaaacgtactttcgactaaacttactactagtacaaactacgtacttacgaacgtcccgaccccccgtatccctaccgtccggacccgaaacgggaccaacgtacgtagggaactaaacgttaaacgaacgtggtacggcctacgcacctactcgtcgtcttactacttccc

SEQ ID NO: 307935 - DNA, 534 bp, Homo sapiens
  misc_feature: GZ8MTXP02GUGHT.22.65.F10.1.454.CMB.2.raw
  modified_base (214)..(214): a, c, t, g, unknown or other
  misc_feature (214)..(214): n is a, c, g, or t
  modified_base (319)..(319): a, c, t, g, unknown or other
  misc_feature (319)..(319): n is a, c, g, or t
  modified_base (480)..(480): a, c, t, g, unknown or other
  misc_feature (480)..(480): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactattaaatgtatcagcagaaaccaggaaacgcccctaagctcctgatctatgctacttccagtttgactaaaggtcgggtcccgtnaaaggttcagtgcagtgatcgtgggacagtatttcactctacaccatccgcggtctgacaacctgaagtattcgactaacttactactagtacaaacacgtacttacacgtccgaccccccgatcctaccgttcgaccgaacggacaacgacgtacggaanaaacgtaaacgaactcgtacgactagaaccactactctacgtctactacttccc

SEQ ID NO: 307936 - DNA, 519 bp, Homo sapiens
  misc_feature: GZ8MTXP02F4CFU.22.65.F10.1.454.CMB.2.raw
  modified_base (268)..(268): a, c, t, g, unknown or other
  misc_feature (268)..(268): n is a, c, g, or t
  modified_base (318)..(318): a, c, t, g, unknown or other
  misc_feature (318)..(318): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaacncccctaagctctgatctatgctacttcagtttgacaaaggtgggtccctnaaggttcagtggcagtggatcgtgggacagatttcactctcaccatccgcgtctcgacaacctgaagtattcgactaacttactactgtacaacagtacttacacgtccgccccccgatccaccgttcgaccgaacggacacgacgtaggacgaacttaaacgacgtcgtacggctcgcacctatctgtccttcacttccc

SEQ ID NO: 307937 - DNA, 516 bp, Homo sapiens
  misc_feature: GZ8MTXP02JNAB2.22.65.F10.1.454.CMB.2.raw
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacctgccggcaagtcagagcataacgtactattaatggtatcagcagaaaccagggaaacncccctaagctcctgatctatgctacttccagtttgcaaaggtcgggtcctnaaggttcagtgcagtggatcgtgggcagtatttcactctcaccatccgcgtctgacacctagaagtacttcgactaacttactactagtacaaactacgtactactacgtccgcccccgatccgtaccgttcggaccaagggacacgacgtacggagtaactaaacgactgtcggactgaacacactctgtctcacttccc

SEQ ID NO: 307938 - DNA, 553 bp, Homo sapiens
  misc_feature: GZ8MTXP02IQFTE.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcataacgtactattaaattggtatcagcagaaaccaggaaacncccctaagctcctgatctatgctacttcagtttgactaaagtcggggtcctgaaaggttcagtgcagtggatcgtgggacagtatttcactctcaccatccgcgtctgacacctgaagtacttcgactaacttactactgtacaacagtacttacacgtcccgcccccgtatcctaccgttcggaccgtaaacgggacacgtacgtacgggaacgtaacttaaaacgacgttacgtacggtacctacggaaccaacctacttcctcgttcttacctactttccccg

SEQ ID NO: 307939 - DNA, 528 bp, Homo sapiens
  misc_feature: GZ8MTXP02GXQZZ.22.65.F10.1.454.CMB.2.raw
  modified_base (189)..(189): a, c, t, g, unknown or other
  misc_feature (189)..(189): n is a, c, g, or t
  modified_base (321)..(321): a, c, t, g, unknown or other
  misc_feature (321)..(321): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccgggcaagtcagagcataacgtactatttaaatgtatcagcagaaaccagggaaacgcccctaagctcctgatctatgctacttccagtttgacaaaggtcggggtaccgtnaaggttcagtggactagtggatcgtgggacagtactttcactctcaccatccgcgtctgcacctgagtacttcgactaacttactactagtcaacacgtacttacacgttaccgcccccgtatccaccttcggaccgacgggacacgacgtacggagaacttaaacgaactgtacgctcgaacacactcctgttcttacactttccc

SEQ ID NO: 307940 - DNA, 517 bp, Homo sapiens
  misc_feature: GZ8MTXP02HJOA7.22.65.F10.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (506)..(506): a, c, t, g, unknown or other
  misc_feature (506)..(506): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagancataacgtatattaaatggtatcagcagaaaccagggaaacncccctaagctcctgatctatgctacttccagtttgacaaaggtggggtcccgtnaaaggttcagtggcagtggatcgtgggcagtatttcactctcaccntccgcgtctgcaacctgaaagtntttacgactaacttactactgttacaaactacgtacttacagtccgacccccgatccacctcggaccaagggacacggactggaagaacttaaaacgactacgtggactgcacatctntctactactcc

SEQ ID NO: 307941 - DNA, 545 bp, Homo sapiens
  misc_feature: GZ8MTXP02JSVDU.22.65.F10.1.454.CMB.2.raw
  modified_base (264)..(264): a, c, t, g, unknown or other
  misc_feature (264)..(264): n is a, c, g, or t
  modified_base (321)..(321): a, c, t, g, unknown or other
  misc_feature (321)..(321): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactattaaatgtatcagcagaaaccaggaaacncccctaagcctcctgactctatgctacttccagtttgactaaggtcggggtccctanaaggttcaggtggcagtggatcgtgggacagtatttcactctacaccatcccgcgtctgacaacctgaagtactttacgactaaacttactactagtacaactacgtacttacgacgtacccgaccccccgtatccctaccgttccggaccgtaacggacacggacgtaggaacgtaacgttaaacgactagtacgctgccactactctacgtctcgacttccc

SEQ ID NO: 307942 - DNA, 524 bp, Homo sapiens
  misc_feature: GZ8MTXP02FNW2V.22.65.F10.1.454.CMB.2.raw
  modified_base (319)..(319): a, c, t, g, unknown or other
  misc_feature (319)..(319): n is a, c, g, or t
  modified_base (508)..(508): a, c, t, g, unknown or other
  misc_feature (508)..(508): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggatcagcagaaaccaggaaacgcccctaagctcctgatctatgctacttccagtttgcaaaggtgggtcccgtnaaggttcagtgcagtggatcgtgggcagatttcactctcacatccgcgtctgcaacctgaagctttcgactaacttactactgtacaacagacttacacgtccgacccccgtatccaccgttcggaccaagggaccaacgacgtaggagtaacgttaaaacgaacgtagtacgctcgaacactactctnttcttactactttccc

SEQ ID NO: 307943 - DNA, 577 bp, Homo sapiens
  misc_feature: GZ8MTXP02I9WSW.22.65.F10.1.454.CMB.2.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggcaagtcagagcaataacgtactattaaatggtatcagcagaaaccaggaaacncccctaagctcctgatctatgctactccagtttgactaaagtcggggtcctnaaaggttcagtgcagtggatcgtgggcagtatttcactctacaccatccgcgtctgcaacgtgaagtactttcgactaacttactactagtacaacagtacttacacgtaccgacccccgatacctaccgttccggaccgaaacgggaccaacggtaccgtaggaacgtaaacgttaaaaccggaaacgtggttacgggaccttacggaacctaacccgtagttaccttcggtttaccctttaccgtaactttcccccg

SEQ ID NO: 307944 - DNA, 527 bp, Homo sapiens
  misc_feature: GZ8MTXP02HQOIF.22.65.F10.1.454.CMB.2.raw
  modified_base (215)..(215): a, c, t, g, unknown or other
  misc_feature (215)..(215): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaattggtatcagcagaaaccagggaaacgcccctaagctcctgatctatgctacttccagtttgactaaagtcggggtacctcgaaggttcagtgcagtggatcgtgggacagtatttcactctcacctatccgcggtctcgacaacctgaagtactttacgactaaacttactactgtacaacagtacttacacgtccgcccccgatccaccttcggaccaagggacacggactaggagaacttaaacgaactcgtacgctgaacacatcgtatcttactacttccc

SEQ ID NO: 307945 - DNA, 565 bp, Homo sapiens
  misc_feature: GZ8MTXP02H4NSW.22.65.F10.1.454.CMB.2.raw
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactattaaattggtatcagcaagaaaccaggaaacncccctaagctctgatctatgctacttccagtttgactaaaggtcggggtacccgtgtaaaggttcagtggcagtggatcgtgggacagtatttcgacttctcaacctatcccgcgtctgacaaccgtgtaagtatttcgacaacttactactgtacaacagtacttaacgacgtcccgacccccgactccgtaccgttacggaccaaaggggaccaacggtacgtaggaacgtaaacttaaaaccgaacgttcgtacggtctacgccgtacaacttctagtctttactacttcccg

SEQ ID NO: 307946 - DNA, 569 bp, Homo sapiens
  misc_feature: GZ8MTXP02IFWL6.22.65.F10.1.454.CMB.2.raw
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacctgccggnaagtcagagcataacgtatatttaatgtatcagcaagaaaccaggaaacncccctaagcctcctgatctatgctactttccagtttgactaaaggtcggggtaccccgtagtaaaggttcaggttggctaggtgggattcgtagggactagtattttccacttcctacacctactcccgtcggtctacgctaaacctgaagtactttacgacctaaacttactactagttacaaacacgtacttacgacgtcccgccccccgatcctaccgttaccggaccgaacggggacaacggtacgtaggaacgtaacttaaacgaactgtacgctcgaactacactctctcttcacttccc

SEQ ID NO: 307947 - DNA, 584 bp, Homo sapiens
  misc_feature: GZ8MTXP02HDAOD.22.65.F10.1.454.CMB.2.raw
  modified_base (190)..(190): a, c, t, g, unknown or other
  misc_feature (190)..(190): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccgggcaagtcagagcaataacgtactaatttaaattggtatcagacaagaaaccgagggaaacgccccctaagcctcctgattctatgcctacttccagtttgacgtaaaggtcggggtaccccgtagtaaaggtttcaggtggctaggtggatcgtggggaccagtatttcactctcaccatccgcggtctgacactagagtacttcgtactaacttactactagtacaactacgtacttacgacgtacccgcccccgtatcctaccgttacggaccgaacgggacaaccggtacgtacggaagtaaacgttaaaacgtacgtacggttacggactacggcgtacctactcttacgtccttactactttccc

SEQ ID NO: 307948 - DNA, 526 bp, Homo sapiens
  misc_feature: GZ8MTXP02H7E3N.22.65.F10.1.454.CMB.2.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactatttaaattggtatcagcagaaacaggaaacncccctaagctctgatctatgctacttccagtttgctaaaggtggggtcccgtnaaggttcagtggcagtggatcgtgggcagtatttcacttctcaccatccgcgtctgcaacctgaagtatttcgactaacttactactagtacaacagtacttacacgtccgaccccccgatccaccgttacggaccaacgggaccacgacgtggaagtaacttaaaacgaactcgacggtctgccacactctagtcttcacttccc

SEQ ID NO: 307949 - DNA, 536 bp, Homo sapiens
  misc_feature: GZ8MTXP02JU6YD.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcataacgtactattaaatgtatcagcagaaaccaggaaacnccctaagctctgatctatgactacttccagtttgactaaaggtcggggtacccctacgaaaggtttcaggtggctaggtggatcgtagggacagtatttcactctacacctatccgcgtctcgacaacctagagtattcgactaacttactactagtacaactacgtactacacgtaccgcccccgatccaccgttcggaccaagggacacgacgtaggagaacgttaaacgaactcgtacgtctacgcacgtactctgtctctacttcccg

SEQ ID NO: 307950 - DNA, 531 bp, Homo sapiens
  misc_feature: GZ8MTXP02JQMAS.22.65.F10.1.454.CMB.2.raw
  modified_base (315)..(315): a, c, t, g, unknown or other
  misc_feature (315)..(315): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgatccagtctccatcctccctgtctgcatctgtaggagacagagtcaccatcacctgccgggcaagtcagagcataacgtactattaaatggtatcagcagaaaccaggaaagcccctaagctcctgatctatgctacttccagtttgcaaagtggggtcctnaaggttccagtgcagtggatcgtgggacagatttcactctcaccatccgcggtctgcaacctagaacgatttcgactaacttactactgtacaacagacttacagtccgccccccgatccgaccttccggaccaaacggggaccaacggacgtaggaacgtaacttaaaacgaacctgttacggctggaccaaccacttctacgttcttactaccg

SEQ ID NO: 307951 - DNA, 565 bp, Homo sapiens
  misc_feature: GZ8MTXP02GB9FJ.22.65.F10.1.454.CMB.2.raw
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactatttaaatggtatnagcagaaaccaggaaancccctaagctcctgatctatgctacttccagtttgcaaaggtgggtccctnaaggttcagtgcagtgatcgtgggacagatttcactctcaccatccgcgtctgacaactgaagatttacgactaacttactactgtacaacagtacttacacgtccgaccccccgtatcctaccgttacggaccgaaacggggaccaaccggaaccgtagggaaagtaaacgttaaaacggaacgttacggtacggtcgtacggaacccgaacccgtaagttacctacgttcctttacactttcccccg

SEQ ID NO: 307952 - DNA, 602 bp, Homo sapiens
  misc_feature: GZ8MTXP02H75GP.22.65.F10.1.454.CMB.2.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactaattaaattggtatcagcaagaaaccaggaacncccctaagcctcngatctatgctacttcctagtttgactaaagtcggggtcccgtagaaggttcagtggacagtggatcgtgggacagtatttcactctcactactcccgtacggtctcgactaaaccgtgtaaagtacgtttccgaacctaaacctttacctaacttacgtacaaacgagtaacttacacgtaccgaccccccgatacccgtaccgttccggaccgaacgggaccaccggtactacgggtagaaacttaaaacggaaccgtacggtacggaccgtaggaacccgtaaccgtaacttcgttacgttccttactaacctttcccg

SEQ ID NO: 307953 - DNA, 585 bp, Homo sapiens
  misc_feature: GZ8MTXP02G04WU.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcataacgtatattaatgtatcagcaagaaaccaggaaacncccctaagctctgatctatgactacttctagtttgacgaaaggtcgggtcctagaaggttcagtgcagtgatcgtgggacagtattcactctacaccntccgcgtctcgacaactgtaagtacttcgactaacttactactagtacaaactacgtacttacacgttacccgacccccgtactacccgtaccgttaccggaaccgaaacggggaaccaaccggtaacgtacgggtaaacgtaaaacgttaaaaccggaaacgttacggtacggacttacgaaccgtaacctacgttctacgttaccttacctactttccccg

SEQ ID NO: 307954 - DNA, 504 bp, Homo sapiens
  misc_feature: GZ8MTXP02H53VP.22.65.F10.1.454.CMB.2.raw
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccatcacctgccgggcaagtcagagcataacgtatattaaattggtatcagcagaaaccaggaaancccctaagctcctgatctatgctacttccagtttgcaaaggtggggtccctnaaaggttcagtggcagtgatcgtgggcagtatttcactctcacatcgcgtctgcaactgaagatttcgctaacttactactgtacaaacagtacttacagtccgaccccccgatcaccttcggaccaacgggacacgacgtggaagacttaaacgaactgtacgctgcacactctgtcttcacttccc

SEQ ID NO: 307955 - DNA, 552 bp, Homo sapiens
  misc_feature: GZ8MTXP02J3KXP.22.65.F10.1.454.CMB.2.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatccaccgtggccgggacaagtcagagactaataaacgtacttatttaaagtgtancagacaagaaaccaggaacncccctaagctcngatcatnctactcagtttnacgtaaggtcgggtcctacaaggttcagtgcaggtgatcggtagggcagtactttcactctacacactccgtcgtctacgactaaccgtagaagtactttcgactaaacctttactacgtatacaacagtaccttacgacgttcccgacccccgatccaccgttcggaccaagggacacgtacgagaacgtaataaacgtacgtgcgtctacgcctactacgtctacgtccttactacgtcc

SEQ ID NO: 307956 - DNA, 550 bp, Homo sapiens
  misc_feature: GZ8MTXP02HKQHA.22.65.F10.1.454.CMB.2.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggcaagtcagagcataacgtactattaaatggtatcagcagaaaccaggaaacncccctaagctcctgatctatgctacttccagtttgacaaaggtcggggtcccgtagaaggttcaggtggcagtggatcgtgggcagtatttcactctacacctatccgcggtctcgacaacctgaagtattcgactaacttactactagtacaaacagtaacttacacgtccgacccccgtatcctaccgttcggacctaacgggacacgacgtaggaagtaacgttaaaacgaacgtgtacggctacggaaccacctacttctcgttaccttctactttcccg

SEQ ID NO: 307957 - DNA, 571 bp, Homo sapiens
  misc_feature: GZ8MTXP02GO1EC.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
  modified_base (351)..(351): a, c, t, g, unknown or other
  misc_feature (351)..(351): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcataacgtactattaatgtatcaacagaaccaggaaacncccctaagctcctgatctatgctacttccagtttgactaaaggtcggggtccctagtaaggttcaggtcggcagtggatcgtgggacngtatttcactctacacacgtccgcgtctgcaactgaagtactttcgactaacttactactagtacaacagtacttacacgtaccgacccccgataccaccgttcggaccgaacgggaccaacggaccgtaggaacgtaaagttaaaacgaacgttaggtacggtactacggtaccaaccgtacttaccttcgttacctttcctactttccctttaccccg

SEQ ID NO: 307958 - DNA, 525 bp, Homo sapiens
  misc_feature: GZ8MTXP02I1Z5S.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcataacgtactattaaatggtatcagcagaaaccaggaaacgcccctaagctcctgatctatgctacttccagtttgcaaagtcgggtccctnaaaggttcagtggcagtggatcgtgggcagatttcactctcaccatccgcgtctgcaacctgaagtatttcgactaacttactacttgtacaaacacgtacttacagtccgacccccgtatccaccgttcgacccgaaagggacacgactaggacgtaacgtaaaacgactgtacggctagaaccgactactctcgtcttcactttccc

SEQ ID NO: 307959 - DNA, 543 bp, Homo sapiens
  misc_feature: GZ8MTXP02HTBQJ.22.65.F10.1.454.CMB.2.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (531)..(531): a, c, t, g, unknown or other
  misc_feature (531)..(531): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcactgccgggcaagtcagancataacgtataattaaattgtatcagcaagaaaccaggaaacncccctaagctcnatctatcgcttacttccagtttgactaaaggtcggggtaccccgtagaaaggtttcagtggactagtggatcgtgggactagtatttcacttctcacctactccgtcgtctcgacacctgaagtacttcgactaacttactactagtcaaacagtaacttacacgtccgacccccgtatcctaccgtcggaccgaaacggacgaacgacgaggagtaaactaaacgtaacgtgtacggctcgaacacactctntctctacttccg

SEQ ID NO: 307960 - DNA, 495 bp, Homo sapiens
  misc_feature: GZ8MTXP02JB8ET.22.65.F10.1.454.CMB.2.raw
  modified_base (213)..(213): a, c, t, g, unknown or other
  misc_feature (213)..(213): n is a, c, g, or t
tcagacatacgcgtcacgaccggtgctcgatttagctacgctctaagggggagtcagtctcagtcaggacacagcatggacatgagggtcccgctcagctcctggggctcctgctactctggctccgaggtgccagatgtgacatccagatgacccagtctccatcctcctgtctgcatctgtaggagacagagtcaccatcacctgccgggnaagtcagagcataacgtactattaaatggtatcagcagaaaccaggaaagcccctaagctcctgatctatgctacttccagtttgcaaagtgggtccgtcaaggttcagtgcagtggatctgggcagatttcactctcacatccgcggtctgcaacctgaagatttcgctaacttactactgtcaacagtacttacagtcgaccccccgatccaccttcggccaacgggacacgactggagacttaaacgaactgtacggctgcaccatctgtcttcattcc

SEQ ID NO: 307961 - DNA, 600 bp, Homo sapiens
  misc_feature: GZ8MTXP02H7RGV.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcaataacgtactatttaaattggtatcagcaagaaaccagggaaacncccctaagctctgatctatcgctacttcctagtttgactaaaggtcggggtccctagaaaggttcaggtggacagtggatcgtgggacagtatttccactctcactactcccgcgtctcgaccaaccgtagtaaagtactttacgactaaacctttactacttagtaccaaactacgtacttaccgacgtacccgacccccccgtatacctacccgttaccggaccgaacgggaccacggaacgtaggaacgtaaacgttaaaaccgtaaccgttaggtacgtacgtacggaacctacctaacttccgtagttccttactactttcccc

SEQ ID NO: 307962 - DNA, 567 bp, Homo sapiens
  misc_feature: GZ8MTXP02JCJEW.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccactcagctcctggggctcctgctactctggctccgaggtgccagatgtgacatccagatgacccagtctccatcctccctgtctgcatctgtagganacagagtcaccatcacctgccgggnaagtcagagcaataacgtactattaaatgtatcagcagaaaccaggaaacncccctaagcctcctgatctatgctacttccagtttgactaaaggtcggggtaccctgaaaggtttcaaggttggacagtggatcgtaggggacagtatttcactctacaccactccgcgtctcgacaaccgtgaaactactttcgactaaactttacacttagtacaaactacgtacttacgacgttacccgccccccgtatacctaccgttcggaccaacgggacaacgtacgtaggagaaacttaaacgaactcgtacggctcgaacctaccacttcgtacgtccttacactttccccg

SEQ ID NO: 307963 - DNA, 574 bp, Homo sapiens
  misc_feature: GZ8MTXP02HG3FY.22.65.F10.1.454.CMB.2.raw
  modified_base (213)..(213): a, c, t, g, unknown or other
  misc_feature (213)..(213): n is a, c, g, or t
  modified_base (274)..(274): a, c, t, g, unknown or other
  misc_feature (274)..(274): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcactggccgggnaagtcagagcataacgtactattaaatgtatcagcagaaaccaggaaagccctaagctccngatctatgctacttccagtttgactaaaagtggggtccctagaaaggttcaagtggcaggtggatcgtgggacagtatttcactctcaccatccgcgtctgcaacctgaagtatttcgactaacttactactgtacaaacagtacttacacgtccgaccccccgactaccacccgttacggacccgaaagggaccaacggaaccgtacgggaaagtaaacgttaaaaacggaaaccgttaggtacgggacttcggaacccacccgaaacttccttacgtcctttacctaactttcccccg

SEQ ID NO: 307964 - DNA, 555 bp, Homo sapiens
  misc_feature: GZ8MTXP02HJ7CJ.22.65.F10.1.454.CMB.2.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (318)..(318): a, c, t, g, unknown or other
  misc_feature (318)..(318): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtatattaaatgtatcagcagaaaccaggaaacncccctaagcctcctgatctatgctacttcagtttgacaaaggtcggggtccctnaaggttcagtgcagtggatcgtgggacagtactttcactctcacctatccgcgtctgacaacctgaagtacttcgactaacttactactagtacaacagtacttacacgtcccgaccccccgatacctaccgttcggaccgaaacggggaccaaccgacgtacggaaagtaaacgttaaaacgtaacgtcgtacggtactacgaaccacctacttctcgttacttactactttcccg

SEQ ID NO: 307965 - DNA, 522 bp, Homo sapiens
  misc_feature: GZ8MTXP02G5SSD.22.65.F10.1.454.CMB.2.raw
  modified_base (317)..(317): a, c, t, g, unknown or other
  misc_feature (317)..(317): n is a, c, g, or t
  modified_base (361)..(361): a, c, t, g, unknown or other
  misc_feature (361)..(361): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactattaaatggtatcagcagaaaccaggaaacgcccctaagctctgatctatgctacttccagtttgctaaaggtgggtcccgtnaaggttcagtggcagtggatcgtggggacagtatttccacttcncaccatccgcggtctgacacctgaagtatttcgactaaacttactactgtacaacagtacttacgacgtccgacccccgataccaccttcgaccaagggacacgactaggaacgaacttaaaacggactagtcggctacgnaccatctntctcacttcccg

SEQ ID NO: 307966 - DNA, 609 bp, Homo sapiens
  misc_feature: GZ8MTXP02HICFE.22.65.F10.1.454.CMB.2.raw
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtatattaaatgatcagcaagaaaccagggaaacncccctaagcctactgatctatcgactacttctagtttgacgtaaggtcggggtccctagtaaaggttcagtggcaggtggatcgtagggactagtactttcaccttctaccaacctactcccgtcggtctacgaccgtaaaccgttagaaacgttactttaccgactaaacctttaactactcgtaaccaaacgtacgtaaccttacacgtacccgaccccccgtatacctaccgttcggaccgaaacgggaccaacggtacgtagggtaaataaacgttaaaacgaacgttcgtaacggtctacgaacctaacctactcttacgttccttactactttccccg

SEQ ID NO: 307967 - DNA, 549 bp, Homo sapiens
  misc_feature: GZ8MTXP02I7P0Z.22.65.F10.1.454.CMB.2.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacctggccggganaagtcagagcataacgtactatttaaattggatcagacaagaaaccgagggaaacncccctaagcctcctgactctatcgtactacttccagtttcgacgtaaaggtcgggtaccctanaaggttcaggtgctagtgatcgngggacagtcttcactctcactntccgtgtctgacaacgtagaagtacttacgactaacttactactgtaccaactacgtactacgtacgtacccgcccccgtancctaccgtacgaccgaacgggacacgacgtagganaacgttaaacgacgtcgtacgctacgcacgtactctgtccttctacttccc

SEQ ID NO: 307968 - DNA, 575 bp, Homo sapiens
  misc_feature: GZ8MTXP02FUGS9.22.65.F10.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (272)..(272): a, c, t, g, unknown or other
  misc_feature (272)..(272): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctgccgggnaagtcagancaataacgtactaatttaaattggtatcagcaagaaaccaggaaacncccctaagcctctgatctatgcttacttccagtttgacaaaggttcggggtaccctagaaaggttcagtggcagtggatcgtaggggactagtatttcactctacacctatccgcgtctgacaacctagaaagtacttacgactaacttactactagtacaaacagtacttacacgtaccgacccccgatacccaccttacggaccgaaacgggaccaacggtaacgtaggaagtaaacgttaaaacgaacgtaggtacgcgtacgaaccgacctattcttacgttccttactactttccccg

SEQ ID NO: 307969 - DNA, 546 bp, Homo sapiens
  misc_feature: GZ8MTXP02HLKUA.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcataacgtactattaaatggtatcagcagaaacaggaaacncccctaagctcctgatctatgctacttcagtttgactaaaggtcggggtacccgtacgaaaggttcaggtggacaggtggatcgtgggactagtatttcactctcacctatccgtcgtctgacaacctagaagtatttcgactaacttactactgtacaacacgtacttacacgtccgcccccgtatacctaccgttcggaccgaacggacgacgacgtacggagtaaacgtaaacgaacgtagtcgcgtgaacctactactactcgtcttcctacttccc

SEQ ID NO: 307970 - DNA, 605 bp, Homo sapiens
  misc_feature: GZ8MTXP02IDNBE.22.65.F10.1.454.CMB.2.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccacctggccgggacaagtcagagcaataacgtactatttaatgtatcagcagaaacaggaacnccctaagctccngatctatgcttacttccagtttcgacgtaaaggtcggggttacccgtagtaaaggttcaggtggcgtaaggtggattcgtagggactagtatttccacttcctaccacctacgtcccgtcgtctacgacctaaccgtagtaacgtactttacgactaaacttactatcgtaacaactagtacttacacgtccccgacccccgatacctaccgttaccggaccgaaacgggaccaacgtacgtacggaaacgtaaacgttaaaaccggtaacgtggtacggtctacgaaccgtaacctacttcgttctcctttaccactttcccccg

SEQ ID NO: 307971 - DNA, 568 bp, Homo sapiens
  misc_feature: GZ8MTXP02JVOND.22.65.F10.1.454.CMB.2.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
  modified_base (554)..(554): a, c, t, g, unknown or other
  misc_feature (554)..(554): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagancaataacgtactatttaaatggtatcagcagaaaccaggaaacncccctaagctcctgatctatgctacttccagtttgactaaaggtcggggtaccccgtacgtaaaggtttcaggtggcgtaggtggatcgtagggacagtactttacactctacaccacgtcccgcggtctgaccaaccgtagaagtattacgactaaacttactactagtacaaactacgtacttacgacgtcccgaccccctactacctacccgtcggaccgaagggacaacgtacgaggaagtaaacgttaaacgacgtagtacggctacgcgaacctatcgtntacttcacttcccg

SEQ ID NO: 307972 - DNA, 682 bp, Homo sapiens
  misc_feature: GZ8MTXP02IK8B2.22.65.F10.1.454.CMB.2.raw
  modified_base (191)..(191): a, c, t, g, unknown or other
  misc_feature (191)..(191): n is a, c, g, or t
  modified_base (262)..(262): a, c, t, g, unknown or other
  misc_feature (262)..(262): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtcctgcatctggagganacagactacaccatccaccgtggccggacaagtcagagacaattaacgtacttaatttaaaagttggtaanacgaacgaacgaaacggaaaccggaacgggaaacctacccctaagtcctacgtagtacttactagtcgtaccttacttacgtaggtttacgaacggtaacgggttccgggtacctaaggtaacggttcgacggtggagtaggtagtacgtcggtaggactagttacttaccacttcctaccaaccgtcgtccgtcgtaccgtacgaacctaacgtagtaaacgttacgttaccaaacttaaacttactaacgttactaaacctaaacgtaacgttaaccttaacgtacccgtacccccgacccccgtattacccgtaccggtaccggaaccgaacggacaacggtacgtaacggtaagtaaacttaaacggacgtcggtacgctacgaactactacgttcgtacttacctactacctccg

SEQ ID NO: 307973 - DNA, 553 bp, Homo sapiens
  misc_feature: GZ8MTXP02HVSNN.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancataacgtatatttaaatgtatcagcaagaaaccagggaaacncccctaagcctcctagatctatgcctacttccagtttgacgtaaaggtcggggtaccctagaaaggttcaggtggactaggtggatcgtagggactagtactttcaccttctcacctatccgcgtctcgacaacctagaacgtatttcgactaacttactactatacaaactacgtacttacacgtacccgacccccgatccaccgttcggaccgaacgggacacgactaggaagaacttaaacgaactgtacggctgaaccacacttcgtctacttctacttcccg

SEQ ID NO: 307974 - DNA, 603 bp, Homo sapiens
  misc_feature: GZ8MTXP02I8EJ8.22.65.F10.1.454.CMB.2.raw
  modified_base (190)..(190): a, c, t, g, unknown or other
  misc_feature (190)..(190): n is a, c, g, or t
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggcaagtcagagcaataacgtactatttaaatggtatcagcagaaaccaggaaacncccctaagctcctgatctatgctacttccagtttgacaaaggtggggtcctcaaaggttcagtgcagtgatcgnggcagtattcactctcaccntccgcgtctgacaactgaagtattcgactaacttactactagtacaaacaacgtacttaccacgtacccgacccccccgaatcccgtaacccgttacgggaccccgaaaacggggacccaaaccggtaaccgtagggaaacgtaaacgtttaaaaccggaacgttacggtacggggtaccttacggaacccgaacccgtaaacgttccctttacggttcctttaccgtaacttttcccccg

SEQ ID NO: 307975 - DNA, 607 bp, Homo sapiens
  misc_feature: GZ8MTXP02GWUNF.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (321)..(321): a, c, t, g, unknown or other
  misc_feature (321)..(321): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancaataacgtatatttaaatggtatcagacaagaaaccagggaaacncccctaagctcctgatctatgctacttcagtttgactaaggtcgggtacctnaaggttcagtggcagtggatcgtagggactagtatttccgactcctacacctatcccgcgtctcgaccacgtagtaagtacttacgactaacttactactcgtacaactagtacctacgtacgtaccgacccccgtatacctaccgttaccggaccgaacgggaccaaccggtacgttacgggaacgtaaacgtttaaaaaccggacgttacggttacggaccgttacggaacccgtaaacccgtacgttaccttcggtttacctttacccgtacttttacccccg

SEQ ID NO: 307976 - DNA, 525 bp, Homo sapiens
  misc_feature: GZ8MTXP02I4PRE.22.65.F10.1.454.CMB.2.raw
  modified_base (214)..(214): a, c, t, g, unknown or other
  misc_feature (214)..(214): n is a, c, g, or t
  modified_base (320)..(320): a, c, t, g, unknown or other
  misc_feature (320)..(320): n is a, c, g, or t
  modified_base (482)..(482): a, c, t, g, unknown or other
  misc_feature (482)..(482): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactattaaatgtatcagcagaaaccaggaaagcccctaagctcctgatctatgctacttccagtttgactaaaggtcggggtaccctanaaagggttcaaggtggacaggtggatcgtggggacagtactttcactctacacatccgcggtctgcaactgaagtactttcgactaacttactactagtacaacacgtacttacacgtccgacccccgatcctaccgtcggaccgaaggacacgactggaanacgtaaacaacgtgtacgctagaacaccatctgtctcactccg

SEQ ID NO: 307977 - DNA, 574 bp, Homo sapiens
  misc_feature: GZ8MTXP02F3D33.22.65.F10.1.454.CMB.2.raw
  modified_base (192)..(192): a, c, t, g, unknown or other
  misc_feature (192)..(192): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtagganacagagtcaccatccacctgccgggcaagtcagagcataacgtactattaaatggtatcagcaagaaaccagggaaacncccctaagctcctgatctatgctacttccagtttgacaaaaggttcggggtacccgtagaaaggtttcaggtggctaggtggaatcgtaggggacaggtactttcaccttctcaaccactccgcggtctgacaacctgaaagtatttacgactaacttactactacgtacaaacagtacttacacgtaccgccccccgatacctaccgttacggaccgaacgggacacggactaggaaacgtaacgtaaaacgaacgtaggtacgtcgtacgaaccgacacttactgtacttccactttcccg

SEQ ID NO: 307978 - DNA, 553 bp, Homo sapiens
  misc_feature: GZ8MTXP02HIFU4.22.65.F10.1.454.CMB.2.raw
  modified_base (189)..(189): a, c, t, g, unknown or other
  misc_feature (189)..(189): n is a, c, g, or t
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccgggcaagtcagagcataacgtactattaatggtatcagcagaaacaggaaacnccctaagctctgatctatgctacttccagtttgactaaaggtcggggtccctagaaggttcaggtgcaggtggatcgtgggactagtattcactctacaccactccgcggtctgacaacctgaagtacttcgactaacttactactacgtacaaactacgtacttacacgtcccgaccccctataccaccgttcggaccaacgggacacgacgtacgggataaactaaacggaacttacggtacgtctacggaacgtaccacttacctacgttcttacctactttccccg

SEQ ID NO: 307979 - DNA, 578 bp, Homo sapiens
  misc_feature: GZ8MTXP02I3R3H.22.65.F10.1.454.CMB.2.raw
  modified_base (190)..(190): a, c, t, g, unknown or other
  misc_feature (190)..(190): n is a, c, g, or t
  modified_base (495)..(495): a, c, t, g, unknown or other
  misc_feature (495)..(495): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggcaagtcagagcaataacgtactatttaaattggtatcagcagaaaccaggaaacgcccctaaagctacctgatctatgctacttccagtttgacaaaggtcgggtacctagaaggttcagtgcagtgatcgtgggcagtatttcactctcacactccgcgtctgacaacctgaagtatttacgactaacttactactagtaccaaacacgtacttacacgtacccgaccccccgataccctaccgttaccggaccaaacgggaccaacgaccgtagggaaanaaacgtttaaaacgaacttacggtaacgggtcttacggaaccaacccgtaagttcccgttacgttaccttacctacgttcccg

SEQ ID NO: 307980 - DNA, 661 bp, Homo sapiens
  misc_feature: GZ8MTXP02IDVBX.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancaataacgtactatttaaattggtatcagcaagaaaccagggaaacncccctaagcctcctgatctatgctactttccagttttgacgtaaaggttcggggtaccccgtacgtaaagggttcaggttcggacgtagggtgggtattccggttaggggacctaaggttaacttttcccaaccttcccttaccaacctaccgtcccgtccgggtccttacggacctaaacccgttagaaacggttacttttacgaccttaaacctttactaacttacgtactaaactacgtaacctttaccgacggtcccgacccccccgtaatcccgtacccgttccggaccgaacggggaccaacgtacggtaggaacgaaactttaaaacggacgttacggtcggtacacgaacctaacctactcttcgttccttactacctttccc

SEQ ID NO: 307981 - DNA, 569 bp, Homo sapiens
  misc_feature: GZ8MTXP02F32YK.22.65.F10.1.454.CMB.2.raw
  modified_base (215)..(215): a, c, t, g, unknown or other
  misc_feature (215)..(215): n is a, c, g, or t
  modified_base (325)..(325): a, c, t, g, unknown or other
  misc_feature (325)..(325): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctgccggnaagtcagagcataacgtactaatttaatggtatcagcaagaaaccaggaaacgcccctaagctcctgatctatgctacttccagtttgacaaaggtcggggtacccgtanaaggttcaggtggctagtggtatcgtagggcagtatttcactctacaccactccgcgtctcgacaacctagaagtactttcgactaacttactactgtactaacacgtacttaccacgtaccgaccccccgtatccgtaaccgttccggaccgaaacgggacaacgacgtaggaacgtaaacgttaaaaccggaactagtacggctacgcctaacctacttctcgttaccttacactttccccg

SEQ ID NO: 307982 - DNA, 604 bp, Homo sapiens
  misc_feature: GZ8MTXP02HA7IZ.22.65.F10.1.454.CMB.2.raw
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatgtatcagcagaaccaggaaancccctaagcctcctgatctatgctacttccagtttgactaaaggtcggggtaccctagaaggttcagtggctaggtggatcgtgggacagtatttcactctcaccatccgcgtctgacaacctgaacgtatttacgactaacttactactagtacaactagtacttacacgtccgaccccccgataccctaccgttaccggaccgaaacggggaccaaccggaccgttacgggaaagtaaacgtttaaaaccggaaaccgttacggtacgggtaccttacggaacccgtaaacccgtaacttaccggttacgtttccctttaccgtaacgttttacccccg

SEQ ID NO: 307983 - DNA, 498 bp, Homo sapiens
  misc_feature: GZ8MTXP02FI2DO.22.65.F10.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaancccctaagctcctgatctatgctacttccagtttgcaaagtgggtcccgtnaaggttcagtgcagtggatcngggcagatttcactctcacatccgcgtctgcaacctgaagattcgactaacttactactagtcaacagacttacacgtcgccccccgtatccaccttcggaccaagggacacgactggagactaaacgaactcgtacgctgcacatctgtactcacttcc

SEQ ID NO: 307984 - DNA, 557 bp, Homo sapiens
  misc_feature: GZ8MTXP02F5CMH.22.65.F10.1.454.CMB.2.raw
  modified_base (213)..(213): a, c, t, g, unknown or other
  misc_feature (213)..(213): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccggnaagtcagagcaataacgtactatttaatggtatcagcaagaaaccaggaaacncccctaagctcctgatctatgcctacttccagtttgacgtaaaggttcggggtaccctagtaaaggttcaggtggctaggtggatcgtagggacagtatttcactctacacctatccgacgtctcgacaacctgaaagtactttacgactaacttactactacgtacaactacgtactacacgtccgaccccccgataccaccttcggaccgaacgggacaacgacgtaggaagtaacgtaaacgaacgtcgtacggctcgaaccgtacactactcgtctactacttcccg

SEQ ID NO: 307985 - DNA, 532 bp, Homo sapiens
  misc_feature: GZ8MTXP02GRYK0.22.65.F10.1.454.CMB.2.raw
  modified_base (190)..(190): a, c, t, g, unknown or other
  misc_feature (190)..(190): n is a, c, g, or t
  modified_base (263)..(263): a, c, t, g, unknown or other
  misc_feature (263)..(263): n is a, c, g, or t
  modified_base (314)..(314): a, c, t, g, unknown or other
  misc_feature (314)..(314): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccggcaagtcagagcaataacgtactattaaatgtatcagcagaacaggaacnccctaagctctgatctatgctactcagtttgacaaaggtcggggtccctanaaggttcaggtggctaggtggatcgtagggacagtatttcactctacacctactccgcgtctcgacactgagtacttcgactaacttactactagtacaacagtactactacgtccacccccgtatcctaccgtcgaccgaacgggacaacgacgtacggaataacgttaaacgacgtacggtcgactgcacgacttctacgtccttacactttcccg

SEQ ID NO: 307986 - DNA, 644 bp, Homo sapiens
  misc_feature: GZ8MTXP02H21M0.22.65.F10.1.454.CMB.2.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctggccgggcaagtcagagcaataacgtactatttaaattggtatcagcaagaaaccaggaaacncccctaagcctaccngatctatcgactaccttcagtttgacgtaaaggtcggggtcccgtagtaaaggttcaggtggactaggtggatcggtagggactagtactttccacttcctccaacctacgtcccgccgggtctcgacctaacgtgaaagtactttacgacttaaacctttactactacgtacaaacagtaaccttacgacggtccccgacccccgtactcccgtacccgttaccgggaacccgaaacgggaaccgaaccggtaacgtacgggtaaacgaaaactttaaaaaccggaacgttcggtaacgggtcctacggaacccgtacccaacttcccttacggttacccttactaccgtttcccccg

SEQ ID NO: 307987 - DNA, 561 bp, Homo sapiens
  misc_feature: GZ8MTXP02IIP5C.22.65.F10.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatccacctgccgggnaagtcagagcataacgtatattaatgtatcancagaaccaggaaacnccctaagctctgatctatcgctacttccagtttgactaaaggtcggggtccctcaaaggttcagtggcaggtggatcgtagggctagtactttcaccttcctcacctatccgcgtctcgacaactagaagtactttacgactaaacttactactacgtacaaacacgtaacttacgacgttacccgaccccccgatacccaccgttccggaccgaacgggaccacgacgtaggaagtaacttaaaacggaacgtgtacggctacgaacaacctaacttctctcctttactacttcccg

SEQ ID NO: 307988 - DNA, 506 bp, Homo sapiens
  misc_feature: GZ8MTXP02GYW3A.22.65.F10.1.454.CMB.2.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (360)..(360): a, c, t, g, unknown or other
  misc_feature (360)..(360): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactatttaaatggatcagcaagaaaccaggaaacncccctaagctcctgatctatgctacttccagtttgcaaaggtcggggtccctgaaggttcagtgcaggtgatctgggcagatttcactctcacntccgcgtctgcaactgaagatttcgactaacttactatcgtacaacagtactacacgtccgcccccgataccaccgttcggaccaacggacgtacgacgtaggaagactaaacgaactcgcggactgcaccatctgtctcacttcc

SEQ ID NO: 307989 - DNA, 576 bp, Homo sapiens
  misc_feature: GZ8MTXP02F21J7.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcataacgtactatttaaatggtatcagcagaaaccagggaaancccctaagctcctgatctatgctacttccagtttgctaaaggtcggggtaccccgtagtaaaggtttcaaggttcggctaaggttcggaattccgtaggggaccaggtactttcacctctacaccactccgcggtctcgacaacctgaacgtatttcgactaacttactactgtacaacagtactacacgtccgaccccccgatccaccttcggaccaacgggaccaacgtacgttagggaaacgtaaacgttaaaaccgaacgtcgtacggtctacgaaccaccacttcgtcttctactactttccccg

SEQ ID NO: 307990 - DNA, 498 bp, Homo sapiens
  misc_feature: GZ8MTXP02FYHMG.22.65.F10.1.454.CMB.2.raw
  modified_base (319)..(319): a, c, t, g, unknown or other
  misc_feature (319)..(319): n is a, c, g, or t
  modified_base (493)..(493): a, c, t, g, unknown or other
  misc_feature (493)..(493): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaagccccctaagctcctgatctatgctacttccagtttgcaaagtggggtcccgnaaggttcagtggcagtggatctggggcagatttcactctcaccatccgcggtctgcaacctgaagatttcgactaacttactactgtcaacagacttacagtcgcccccccgatccaccttcggccaagggacacgactggagactaaacgactgtggctgcacatctgtctcnctccc

SEQ ID NO: 307991 - DNA, 527 bp, Homo sapiens
  misc_feature: GZ8MTXP02F8SWR.22.65.F10.1.454.CMB.2.raw
  modified_base (267)..(267): a, c, t, g, unknown or other
  misc_feature (267)..(267): n is a, c, g, or t
  modified_base (326)..(326): a, c, t, g, unknown or other
  misc_feature (326)..(326): n is a, c, g, or t
  modified_base (484)..(484): a, c, t, g, unknown or other
  misc_feature (484)..(484): n is a, c, g, or t
  modified_base (522)..(522): a, c, t, g, unknown or other
  misc_feature (522)..(522): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccaggaaacncccctaagctcctgatctatgctactttccagtttgctaaaggttcggggtccccgtanaaacggttcaggttggctagtggattcgtggggacagatttcacttctcaccatccgcggtctgcaactgaagacttcgactaacttactactgtacaacacgtactacagtccgccccccgtatccaccgttcggaccaagggacacgactacgganaacgttaaacgaactcgtacgctgcacatctgtctacncttcc

SEQ ID NO: 307992 - DNA, 596 bp, Homo sapiens
  misc_feature: GZ8MTXP02FLYG0.22.65.F10.1.454.CMB.2.raw
  modified_base (190)..(190): a, c, t, g, unknown or other
  misc_feature (190)..(190): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccggcaagtcagagcaataacgtatatttaatgtatcagcaagaaaccagggaaacncccctaagctcctagatctatgcttacttccagtttgacgtaaaggtcggggtaccctagaaggttcagtggcaggtggatcgtagggactagtactttcacttcctacacctatccgcgtctcgactaacctagtaagtactttacgactaaacttactactagtacaaactacgtacttacgacgtacccgaccccccgtataccgtaccgttacggaccgaaacgggaccgtaacgtaacgtacggaaagtaaacgttaaaacgaacgtacggtacggactacgaaccgtaccgtacttccgttcgttaccttactactttccccg

SEQ ID NO: 307993 - DNA, 600 bp, Homo sapiens
  misc_feature: GZ8MTXP02IFRYR.22.65.F10.1.454.CMB.2.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcactgccggnagtcagagcataacgtactaattaaattggtatcagacaagaaaccgaagggaaacncccctaagcctcctgactctatgacctacttcctagtttgacgtaaaggtcggggtaccctagtaaggttcaggtggacaggtggtatcggtagggactagtatttccaccttcctacaacctacgtcccgtcggtcctacgaccaaccgtagtaacgtacttacgaactaacttactactacgtacaacagtacttacgacgtacccgacccccgtatccctaccgtaccggaccgaaacgggaccaacgtacgtacggaacgtaaacgttaaacgtactacggtacgactacgaacctacgtacttcctcgttccttactacttccccg

SEQ ID NO: 307994 - DNA, 561 bp, Homo sapiens
  misc_feature: GZ8MTXP02GVIPS.22.65.F10.1.454.CMB.2.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactattaatgatcagcagaaaccaggaacnccctaagctctgatctangctacttcagtttnacgaaaggtcgggtacctgaaaggttcagtgcagtggatcgtgggacagtatttcactctacaccatccgcgtctgacaacctgaagtattcgactaacttactactagtacaaacacgtaacttacagtacccgacccccctatcctaaccgttcggaccgaaacgggaccaaccgaacgtgggaaagtaaacgttaaaaccggaacgttaggacggtctacggaaccgaaccctaacttccgtcgtacctttacgtactttccccg

SEQ ID NO: 307995 - DNA, 601 bp, Homo sapiens
  misc_feature: GZ8MTXP02JFQXR.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagngcataacgtactattaatggtatcagcagaacaggaacncccctaagctctgatctatgctactcagtttgacgtaaggtcgggtcctagaaggttcaggtgcaggtgatcgtgggctagtactttcacttctaccaccagtcccgcgtctcgactaccgtagtaaacgtactttacgacctaacttacctacgtacttaccaaacgtacgtaaccttaccaccgttacccgaccccccgtactaccgtacccgttccgggaaccgaaacggggaccaaccggtacgtaacgggtaaagtaacgtttaaaaaccgaacgttggtacggtcctaacggcctaaacctacgttctacgtttccttacctaactttcccccg

SEQ ID NO: 307996 - DNA, 560 bp, Homo sapiens
  misc_feature: GZ8MTXP02H2BSQ.22.65.F10.1.454.CMB.2.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccggnaagtcagagcataacgtatattaatgancagcagaacaggaacnccctaagctcngatctancgtctacttccagtttgctaaaggtcgggtcctagaaaggttcagtggctagtcggatcgtagggctagtatttccactctcactactccgcggtctcgacaacctgaacgtatttcgactaacttactactagtacaactagtacttacgacgtccgacccccgatacctaccgtcggaccgaagggaccaacggtacacgggtaataaacgttaaaacggaacgttacggtacggcgttacgaaccgacctaacttccgttacgtcctttactacctttcccg

SEQ ID NO: 307997 - DNA, 569 bp, Homo sapiens
  misc_feature: GZ8MTXP02IONBA.22.65.F10.1.454.CMB.2.raw
  modified_base (211)..(211): a, c, t, g, unknown or other
  misc_feature (211)..(211): n is a, c, g, or t
  modified_base (218)..(219): a, c, t, g, unknown or other
  misc_feature (218)..(219): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (368)..(368): a, c, t, g, unknown or other
  misc_feature (368)..(368): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcacatcactgccggnagtcagnnataacgtatattaatgtancagcagaaacaggaaanccctaagctctgatctatcgtctactttcctagtttcgacgtaaaggtcgggtacccgtagtaaaggttcaggtggcaggtgatcgtagggactagtatttcactctacaacnctccgcggtctacgacaacctagagtacgtttcaactaacttactactacgtacaaactaagtaccttacgacgtcccgtacccccgatcctacccgttccggaccgaaacgggacaacggtacgtaggtaaactaacgtaaaacggaactggtacggctacgaacctacctaactccgtacgtccttactactttccccg

SEQ ID NO: 307998 - DNA, 624 bp, Homo sapiens
  misc_feature: GZ8MTXP02HSFZU.22.65.F10.1.454.CMB.2.raw
  modified_base (191)..(191): a, c, t, g, unknown or other
  misc_feature (191)..(191): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctccatcctccctgtctgcatctgtagganacagagtcaccatcacctggccggcaagtcagagacaataacgtacttaatttaaattggtatacagacaagaaaccgagggaaacgacccctaagcctcctgacttctatcgcttacttcctagttttgacgtaaaggtcgggtacccgtagtaaggttcaggtggacaggtggtatcggttagggacgtagtactttcaccttactaccacctactcccgtcggtctcgactaacctagtaagtactttacgtactaaactttactacttacgtacaaactacgtaacttaccgacgtcccgacccccgtataccctaccgttccggaaccgaaagggaccgaacgtacgtacggaacgtaaacgttaaaacggtaacgttcgtacggtcgtagaacccaactacttcgtacttacttacctactttcccg

SEQ ID NO: 307999 - DNA, 574 bp, Homo sapiens
  misc_feature: GZ8MTXP02F850Y.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccggnaagtcagagcaataacgtacttaatttaaattggtatcagcaagaaaccagggaaacncccctaagctcctgatctatcgctacttccagtttgactaaggtcggggtccctgaaaggttcagtgcaggtggatcgngggcagatttcactctcaactntccgcgtctgacaacctgaagtcttcgactaacttactactgtacaacagtacttacgacgtcccgaccccccgtatcccgtaccgttccggaccaacgggaccaacggaaccgtgggaaacgtaacgttaaaaccggacgttaggtacggacttacggaaccgaaccctattccgttcgttaccttcctactttccccg

SEQ ID NO: 308000 - DNA, 628 bp, Homo sapiens
  misc_feature: GZ8MTXP02GFDI4.22.65.F10.1.454.CMB.2.raw
  modified_base (276)..(276): a, c, t, g, unknown or other
  misc_feature (276)..(276): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctggccggacaagtcagagcaataacgtacttaatttaaattggtatcagacaagaaaccgaggaaacncccctaagcctcctagacttctatcgtaccttactttccgtaagttttcggaacgtaaacggggttcggggttaccccgtacgtaaacggtttcgaacgggttggactaggtggtattccggtagggactaggtactttacacttccgtaccaccgtactcccggtcgtccgtgacctaacgtagtaacgtacttacgacttaacttactactagtacaaactacgtactacacgtacccgacccccgtactccacccgttcggaccgaacggacgaacgacgtacggagtaaacgttaaacgacgtcggtcgcgtacgaacgtaccacttcgtcgtcttactaccttcccg

SEQ ID NO: 308001 - DNA, 575 bp, Homo sapiens
  misc_feature: GZ8MTXP02I5I17.22.65.F10.1.454.CMB.2.raw
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaacncccctaagctcctgatctatgctacttccagtttgacaaaggtcggggtccctcaaaggttcagtggcagtggatcgtgggacagtatttcactctcactatccgcgtctgacaacctgaagtacttcgactaacttactactagtacaaacagtacttacacgtaccgaccccccgtatacctacccgttacggacccgaaacggggaccaacgtaaccgtacgggaaagtaaacgtttaaaacgaaaccgttggtaacggcttacggaaccgtaccctaattctacgttccttactaactttcccc

SEQ ID NO: 308002 - DNA, 582 bp, Homo sapiens
  misc_feature: GZ8MTXP02HJCVQ.22.65.F10.1.454.CMB.2.raw
  modified_base (212)..(212): a, c, t, g, unknown or other
  misc_feature (212)..(212): n is a, c, g, or t
  modified_base (267)..(267): a, c, t, g, unknown or other
  misc_feature (267)..(267): n is a, c, g, or t
  modified_base (386)..(386): a, c, t, g, unknown or other
  misc_feature (386)..(386): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagatcaccatcacctgccggnaagtcagagcaataacgtactattaaattggtatcagcaagaaaccgaggaaacncccctaagcctcctgatctatcgctacttccagtttgacgtaaaggttcggggtccctagtaaggttcacggtgactagtggatcgtagggacagtatttcactctacacctactccgnggtctcgacaactgaagtacttcgactaacttactacttagtacaaactacgtacttacgacgttacccgaccccccgatacccgtaccgttcggacccgtaacgggaccaccggtacgtacggaacgtaaacgttaaaaccgacgtacggtacggcctacggaaccactacgtctacgttcttactactttcccg

SEQ ID NO: 308003 - DNA, 543 bp, Homo sapiens
  misc_feature: GZ8MTXP02HHNVY.22.65.F10.1.454.CMB.2.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtcccgctcagctcctggggctcctgctactctggctccgaggtgccagatgtgacatccagatgacccagtctccatcctcctgtctgcatctgtagganacagagtcaccatcacctgccgggnaagtcagagcataacgtatattaaatgtatcagcagaaaccaggaaacgcccctaagctcctgatctatgctacttccagtttgactaaggtcggggtacctnaaggttcaggtggcagtggatcgtagggacagtattcactctacaccactccgcggtctgacaactgaacgtcttacgactaacttactactagactaaacagtacttacacgtccgacccccgataccaccttcggaccgaacgggacacgaacgtacggactaacgttaaaacgaacgtacgtcggactacgaacgtacactcttacgtcctttacactttcccg

SEQ ID NO: 308004 - DNA, 609 bp, Homo sapiens
  misc_feature: GZ8MTXP02IG1OQ.22.65.F10.1.454.CMB.2.raw
  modified_base (139)..(139): a, c, t, g, unknown or other
  misc_feature (139)..(139): n is a, c, g, or t
  modified_base (269)..(269): a, c, t, g, unknown or other
  misc_feature (269)..(269): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagangttttgacatccagatgacccagtctccatcctccctgtctgcatctgtaggagacagagtcaccatcacctgccgggcaagtcagagcataacgtactatttaaattgtatcagcagaaacaggaaacncccctaagctctgatctatgtctacttccagtttcgctaaaaggtcggggtcccctagtaaaggtttcaggtggctaggtggatcgtagggctagtatttccacttctcaccactcccgtcggtctcgacctaaccgtagaacgtactttacgactaaacttactacttagtaacctaaacgacgttaacttaacctacggtacccgacccccccgattacctacccgtttaccgggaccgaaacggggaccaacgacgtaggaagtaacttaaaaccggaccgtagtacggcctacggaacctaacccttacgttaccttcgttaccttactactcccg

SEQ ID NO: 308005 - DNA, 574 bp, Homo sapiens
  misc_feature: GZ8MTXP02JCYUV.22.65.F10.1.454.CMB.2.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagancataacgtatattaatgtatcagcaagaaaccgaggaaacncccctaagcctcctgatctatgctacttcagtttgacgtaaaggtcggggtacccgtagaacggttcaggtggactaggtggatcgtagggactagtactttacactctaccacctacgtccgtcggtctcgacaaccgtagtaagtacttacgactaacttactactagtacaacacgtactacacgtccgacccccgtatccgtaccgtcggaccgtaacgggaccacgtacgaggaactaaacgtaaacgtaacgtcgtacggtactacgtaaccacctacgtctacgtccttacgtactttcccg

SEQ ID NO: 308006 - DNA, 602 bp, Homo sapiens
  misc_feature: GZ8MTXP02G8CLS.22.65.F10.1.454.CMB.2.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
  modified_base (324)..(324): a, c, t, g, unknown or other
  misc_feature (324)..(324): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcaataacgtactaatttaaatggtatcagcaagaaaccgaggaaacncccctaagctctgatctatgctacttcagtttcgactaaggtcggggtccctanaaaggttcaggtgctaggtggatcgtagggactagtatttccaactctacacctacgtccgcggtctcgacaaccgtgtaactactttcgactaaacttactactagtacaacacgtacttacgacgtacccgacccccgtataccgtacccgttacgggaccgaaacggggaaccaaccggtaacgtacgggaaacgtaaacgttaaaacggaaacgtacggttacggctacggaacctacccgtattccgttacgttcctttactaactttccccg

SEQ ID NO: 308007 - DNA, 507 bp, Homo sapiens
  misc_feature: GZ8MTXP02I5ADD.22.65.F10.1.454.CMB.2.raw
  modified_base (316)..(316): a, c, t, g, unknown or other
  misc_feature (316)..(316): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaacaggaaagcccctaagctcctgatctatgctacttccagtttgcaaagtggggtcctnaaaggttcagtgcagtggatcgtgggcagtatttcacttcctcaccatccgcggtctgacaacctgaagatttcgctaacttactactgtacaacacgtacttacagtccgccccccgatccaccgttacggccaagggacacgactggaagacttaaaacgactcgtagctgcacatctgtctcattccc

SEQ ID NO: 308008 - DNA, 550 bp, Homo sapiens
  misc_feature: GZ8MTXP02FVD6S.22.65.F10.1.454.CMB.2.raw
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccaggaaacncccctaagctcctgatctatgctacttccagtttgactaaaggttcggggtaccccgtagaaagggtttcaaggttgggactaggttcgggattccgtaggggaccaagtactttacacctctacacctatccgcggtctcgacaacctgaagtacttcgactaacttactactagtacaaacacgtacttacgacgtccgccccccgatccaccgttcggaccaacgggaccacgactaggataactaaacgactacgtcgctgcacatctgtctcactccc

SEQ ID NO: 308009 - DNA, 720 bp, Homo sapiens
  misc_feature: GZ8MTXP02I7QSP.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcataacgtataattaaatggtatcagcaagaaaccgaggaaacgcccctaagcctcctgattctatcgcttacttcctagtttgacgtaaaggttcggggtacccgtagaaaggttcagttggctaggtggtatcgtgggactagtactttcgaaccttctccgaacctacgtcccggtcggttacccttcggaacctaaacccgttagtaaaacgttacgtttacccggtaccttaaaacctttaaccgttaaccttacggttaacctaaaaccgtaacggttaaaccctttaaaccggtaaccggttacccccgtacccccccccggtaattacccccgtaaccccggtttaccccgggacccgtaaaaccgggggaaacccaccggtaaaccgtacggggtaaacgtaacgtttaaaaaccggtaaccgttgggtaacggtccgttacggaacctaacccgattccgttacgttcctttacctaactttccccg

SEQ ID NO: 308010 - DNA, 571 bp, Homo sapiens
  misc_feature: GZ8MTXP02HA0C9.22.65.F10.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccgggnaagtcagancaataacgtatattaaatgtatcagcagaaaccgaggaaacnccctaagcctctgatctatcgctacttccagtttgacgtaaagggtcgggtacctgtaaggttcaggtggcaggtggatcgagggactagtacttcactctacacctagtccgcgtcctgacctaaccgtagtaaacgtacttcgacttaaacttactactacgtacaaacataaccttacacgttcccgacccccgtatacccgaccgttaccggaccgaacggaccgacgtaaccgtaggaacgtaaacgttaaaccgaagtcggtacgctacgaactacctatctcttctctactttcccg

SEQ ID NO: 308011 - DNA, 572 bp, Homo sapiens
  misc_feature: GZ8MTXP02FXK6B.22.65.F10.1.454.CMB.2.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (322)..(322): a, c, t, g, unknown or other
  misc_feature (322)..(322): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggcaagtcagagcaataacgtactaatttaaatggtatcagcaagaaaccaagggaaacncccctaagctcctgatctatgctacttcagtttgacaaggtcgggtcctanaaggttcagtgcagtgatcgtgggcagtatttcactctcacctatccgcggtctcgacaacctagaagtacttacgactaacttactactacgtacaaactacgtacttacacgtacccgaccccccgtatacccgaccgttccggaccgaaacgggaccaacgtacgtacggaagtaaacgttaaaacgaacgtacgtacggtactacgaaccgtacccgtaattctcgttaccttactactttccccg

SEQ ID NO: 308012 - DNA, 502 bp, Homo sapiens
  misc_feature: GZ8MTXP02IVSXL.22.65.F10.1.454.CMB.2.raw
  modified_base (215)..(215): a, c, t, g, unknown or other
  misc_feature (215)..(215): n is a, c, g, or t
  modified_base (318)..(318): a, c, t, g, unknown or other
  misc_feature (318)..(318): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcataacgtactattaaattggtatcagcagaaaccaggaaacgcccctaagctcctgatctatgctacttccagtttgacaaggtcgggtcctnaaggttcagtgcagtgatcgtgggacagatttcactctcacanccgngtcngcactgatnttcgactaacttactactgtacaaacacgtacttacagtcccgcccccgatcctaccgttcggaccaagggacacgactggagactaaacgactcgtacgctgcacactctgtcttcacttccc

SEQ ID NO: 308013 - DNA, 592 bp, Homo sapiens
  misc_feature: GZ8MTXP02F7TZT.22.65.F10.1.454.CMB.2.raw
  modified_base (190)..(190): a, c, t, g, unknown or other
  misc_feature (190)..(190): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgatccagtctccatcctccctgtctgcatctgtagganacagagtcacatcacctgccggcaagtcagagcataacgtactattaaatgtatcagcagaaaccaggaaacgcccctaagctcctgatctatgtctacttccagtttgcgtaaaggtcggggtcccctagtaaggttccagtggactaggtggatcgtgggacagtatttcactctcaccatccgcggtctcgcaaccctgaacgtactttacgactaaacttactactagttacaacgtacgtacttaacgacgttacccgaccccccgtataccctacccgttaccggaccgaaacggggaccaacggacgttacgggaaacgtaaacgttaaaaccgtaacgtacggtacggtaccgttaaggaccctaacctacgttacctcgttaccttacttacc

SEQ ID NO: 308014 - DNA, 522 bp, Homo sapiens
  misc_feature: GZ8MTXP02JPKMR.22.65.F10.1.454.CMB.2.raw
  modified_base (322)..(322): a, c, t, g, unknown or other
  misc_feature (322)..(322): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaacgcccctaagcctcctgatctatgctacttccagtttgacaaaggtggggtccctnaaggttcagtgcagtggatcgtgggcagtatttcactctcaccatccgcgtctgtaacctgaagtatttcgactaacttactactgtacaactagacttacacgtccgacccccgatccaccttcggaccgaagggacacgactaggacgtaattaaacgaacgtgtacgctgacaaccatctgtcttcactccttcccg

SEQ ID NO: 308015 - DNA, 527 bp, Homo sapiens
  misc_feature: GZ8MTXP02HG2ZM.22.65.F10.1.454.CMB.2.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
  modified_base (348)..(348): a, c, t, g, unknown or other
  misc_feature (348)..(348): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggcaagtcagagcataacgtactattaaatggtatcagcagaaaccaggaaacncccctaagctcctgatctatgctacttccagtttgactaaaggtcggggtcccgtagaaaggttcaggtggcagtggatcgngggacagtattcactctcaccatccgcgtctcgcaacctgagtattcgactaacttactactgtacaaacagtacttacacgtccgcccccgatccaccgttcgaccgaacggacacgacgtaggagtaacgtaaacgactcgtacggctacgcaccactctgtccttactacttcccg

SEQ ID NO: 308016 - DNA, 665 bp, Homo sapiens
  misc_feature: GZ8MTXP02GDUIH.22.65.F10.1.454.CMB.2.raw
  modified_base (221)..(221): a, c, t, g, unknown or other
  misc_feature (221)..(221): n is a, c, g, or t
  modified_base (277)..(277): a, c, t, g, unknown or other
  misc_feature (277)..(277): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatccctccctgtctgcatctggtaggagacagagtcaccatccacctggccggganaagtcagagacaataacgtacttaatttaaatggtatcagcaagaaaccaggaacncccctaagctcctgatctatgctacttccagtttgacaaagggttcggggtaccctagaaggttcaggtggctaggtggatccgtaggggactagtactttcactctaccacctacgtcccggtcggttcctacgtacctaaccgttagtaaacggttactttaccgaaccttaaactttaacctaccttacggtaacctaaaccgtaacgtaacctttaaccgaccggttaccccgtaccccccccggtattaccccgtacccgtttaccgggacccgtaaacgggacccgaacggtaacgtacggaaacgtaaacgttaaaaccgaacgttggttacggcgttacgaaccgtaacctattcctagttccttactaccgtttccccg

SEQ ID NO: 308017 - DNA, 609 bp, Homo sapiens
  misc_feature: GZ8MTXP02GXSU1.22.65.F10.1.454.CMB.2.raw
  modified_base (190)..(190): a, c, t, g, unknown or other
  misc_feature (190)..(190): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgccgcaacaagtcagagacaataacgtactaatttaaatggtatcagacaagaaaccagggaaacgccctaaagctcctagatctatgctacttccagtttgacgaaaggtcggggtaccctagtaaggttccagtggacaggtgatcgtggggacagtattcactctcaccatccgtcgtctcgacaaccgtgaacgtacttcgaactaaccttactactgttaacaactaagtaaccttaacgacgtacccgtaccccccgtaattacccgtaacccgttaccggaccgtaaacggggaaccaaccggtacgtacggtaaacgtaaacgtttaaaacgaaccgttggttacgggacctaacggaccaaccgtactaccgttcgtacctttacttaacccg

SEQ ID NO: 308018 - DNA, 693 bp, Homo sapiens
  misc_feature: GZ8MTXP02FPAFY.22.65.F10.1.454.CMB.2.raw
  modified_base (189)..(189): a, c, t, g, unknown or other
  misc_feature (189)..(189): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagatcaccatcacctgccgggcaagtcagagcaataacgtatatttaaatggtatcagcagaaaccagggaaacncccctaagctctgatctatcgcttacttcctagtttagacgtaaagggttcggggtaccccgtagtaaagggttcaaggtcgggacaggtgggaactccggtaggggacctaggtactttttccgaaccttcctacctaaacccgtacgttcccggtaccggttccgtacggtacctaaacccgttaggtaaacgtacgttttaccgaaccttaaaccttaaccttaacgttacggtacctaaacgtaacgtaaccgtttaccgaaccggttcccgaccccccccgtaatacccgtaacccgttacccggaaccggtaaacgggaccgtaacggaaccgtacggtaaacggttaaacgttaaaaccgtacgttacggtacggtctacgaaccgtactaacttcgttacgtcttactacgtttccccg

SEQ ID NO: 308019 - DNA, 554 bp, Homo sapiens
  misc_feature: GZ8MTXP02G4LSP.22.65.F10.1.454.CMB.2.raw
  modified_base (214)..(214): a, c, t, g, unknown or other
  misc_feature (214)..(214): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccgggnaagtcagagcataacgtactattaaatgtatcagcagaaaccaggaaacgccccctaagctcctgatctatgctacttccagtttgcgtaaaggtcgggtcccgtagtaaaggttcaggtggcagtgatcgtgggcagtatttcactctacactactccgcggtctcgacaacctgtaagtacttcgactaacttactactagtcaaacagtacttacacgtccgccccccgatccgtacctcggaccgaacggggacaacgtaccgtaggaacgtaaacgtaaaaccgtaaacgtgtacggccttacggcacctactcttagtccttacactttccccg

SEQ ID NO: 308020 - DNA, 564 bp, Homo sapiens
  misc_feature: GZ8MTXP02F9CS0.22.65.F10.1.454.CMB.2.raw
  modified_base (219)..(219): a, c, t, g, unknown or other
  misc_feature (219)..(219): n is a, c, g, or t
  modified_base (513)..(513): a, c, t, g, unknown or other
  misc_feature (513)..(513): n is a, c, g, or t
  modified_base (551)..(551): a, c, t, g, unknown or other
  misc_feature (551)..(551): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatccacctggccggganaagtcagagacaataacgtactaatttaaatggtatcagcaagaaaccaaggaaacgcccctaaagctcctgatctatgctacttcagtttgactaaagggtcggggtacccgtagaaaggttcagttggctaggtggatcgtagggacagtactttcactctcacctatccgtcgtctgactaaccgtagaagtactttacgactaaacttactactacgtacaaactagtacttacacgtcccgaccccccgatcctaccgtacggaccaacgggactaacgacgtaggaanaaacgttaaacgaacgtgtacggctagaacaccatctntctactacttccc

SEQ ID NO: 308021 - DNA, 510 bp, Homo sapiens
  misc_feature: GZ8MTXP02F6G3J.22.65.F10.1.454.CMB.2.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctgccgggcaagtcagagcataacgtactatttaaattggtatcagcagaaaccagggaaagccccctaagctcctgatctatgctacttccagtttgcaaagtggggtcccgtnaaggttcagtggcagtggatcgtgggcagatttcactctcaccatccgngtctgcaacctgaagatttcgctaacttactactgtacaacagacttacacgtcgcccccccgatccaccttcggccaaggacacgactcggagactaaaacgaactgtacgctagcacactctagtcttacacttccc

SEQ ID NO: 308022 - DNA, 526 bp, Homo sapiens
  misc_feature: GZ8MTXP02FZ70O.22.65.F10.1.454.CMB.2.raw
  modified_base (267)..(267): a, c, t, g, unknown or other
  misc_feature (267)..(267): n is a, c, g, or t
  modified_base (326)..(326): a, c, t, g, unknown or other
  misc_feature (326)..(326): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcagaaaccagggaaancccctaagctcctgatctatgcttacttccagtttgacaaaggttcggggtaccccgtnaaagggttcagtggcagtggatctggggcagatttcactctcaccatccgcggtctgacaacctgaagtatttcgactaacttactactagtacaacagtacttacacgtccgaccccccgatccaccgttcggaccaacggacacgacgtaggacgattaaaacgactgtcggctgcaccatctgtctacactttcccg

SEQ ID NO: 308023 - DNA, 631 bp, Homo sapiens
  misc_feature: GZ8MTXP02JLWCK.22.65.F10.1.454.CMB.2.raw
  modified_base (95)..(95): a, c, t, g, unknown or other
  misc_feature (95)..(95): n is a, c, g, or t
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (264)..(264): a, c, t, g, unknown or other
  misc_feature (264)..(264): n is a, c, g, or t
tcagacatacgcgtcacgaccggtgctcgatttagctacgctctaagggggagtcagtctcagtcaggacacagcatggacatgagggtccccgntcagctcctggggctcctgctactctggctccgaggtgccagatgtgacatccagatgacccagtcctccatcctcctgtctgcatctgtagganacagagtccaccatcacctggccggnaagtcagagcataacgtatattaatgtatcagcagaaaccaggaaacncccctaagctctgatctatgctacttccagtttgacgtaaggtcgggtaccctagaaggttcaggtcgcaggtggatcgagggactagtatttccacttctcgaacctacgtccgtcggtactcgaccgtaaccgtagtaaacgtacttaccgaactaaaccgttactaacgttacgtaccaaacgtacgtaccttaaccgtacgttacccggacccccccgtagttaccccgtaacccgttccggaaccgaacgggtaccaaccggtaacgtacggtaaacgtaaacgttaaaaccgaacggttacgtacggtacgtacggaacctaaccgtacgttaccgttacgtacctttactactttccccg

SEQ ID NO: 308024 - DNA, 637 bp, Homo sapiens
  misc_feature: GZ8MTXP02I2XXB.22.65.F10.1.454.CMB.2.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacctgccgggnaagtcagagcataacgtactattaaattgtatcagcagaaaccaggaaacnccctaagctcctgatctatgctacttccagtttcgactaaaggttcggggtacccgtacgtaaacgggtttcaaggttcggactagtcgggaattccgtaggggactaggtatttccaccttctacacctatcccgcggttctcgaccaaccgtagaaacgtactttacgactaaacttactacttacgtacaaacacgtacttacgacggtaccgaccccccgtataccctaccgttacggacccgtaaacggggaccaaccggtaacgtacgggaaacgtaacgttaaaaccggaacgttacggttacgggcctacggaaccgaaacccgtaacttaccgttcggtttacctttactaccgttttccccg

SEQ ID NO: 308025 - DNA, 525 bp, Homo sapiens
  misc_feature: GZ8MTXP02JTG1F.22.65.F10.1.454.CMB.2.raw
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (373)..(373): a, c, t, g, unknown or other
  misc_feature (373)..(373): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaatgtancagcaagaaaccaggaaacgcccctaagctcctgatctatgctacttcctagtttgactaaaggtcggggtccctntaaaggttcaggtggctaggtggatcgtgggcagtatttcactctacaccntccgcgtctcgcacctgaagtcttcgactaactactactgtacaacagactacacgtccacccccgatcctaccttcggaccaacgggacacgactaggataacttaaacgaactgacggctcgaacaccacttctcgtacttctacttccc

SEQ ID NO: 308026 - DNA, 551 bp, Homo sapiens
  misc_feature: GZ8MTXP02F6ROJ.22.65.F10.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatccacctgccgggnaagtcagancataacgtatatttaatgatcagcaagaaaccaggaaacncccctaagctctgatctatgctacttcctagtttgacgtaaagggttcggggtaccctagaaaggttcaggtggctaggtggatcgtaggggacagtatttccacttctcacctatccgcgtctcgactaacgtagtaagtacttcgactaacttactactacgtacaacacgtaacttacaacgtccgacccccgtatccaccgttcggaccgaacgggacacggacgtaggaagtaacgttaaacgacgtgtacggctacgcactatcgtctctactacttccc

SEQ ID NO: 308027 - DNA, 536 bp, Homo sapiens
  misc_feature: GZ8MTXP02HX955.22.65.F10.1.454.CMB.2.raw
  modified_base (189)..(189): a, c, t, g, unknown or other
  misc_feature (189)..(189): n is a, c, g, or t
  modified_base (268)..(268): a, c, t, g, unknown or other
  misc_feature (268)..(268): n is a, c, g, or t
  modified_base (523)..(523): a, c, t, g, unknown or other
  misc_feature (523)..(523): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccgggcaagtcagagcaataacgtactaatttaaatggtatcagcagaaaccagggaacncccctaagctctgatctatgctacttcagtttgactaaaggtcggggtcctagaaggttcagtggctaggtgactcgtagggctagtatttcacttctcacctactccgcgtctagcaaccgtgagtacttcgactaacttactactcgtacaaacagtaactacacgtccgacccccgatcctaccgttcgaccaacgggacacgtactaggactaacgtaaacgaacgtcgtacgcgtcgaacacctatcgtntcttctacttccc

SEQ ID NO: 308028 - DNA, 642 bp, Homo sapiens
  misc_feature: GZ8MTXP02HXCHX.22.65.F10.1.454.CMB.2.raw
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctcctgtctgcatctgtaggagacagatcacatcacctgccggganaagtcagagcaataacgtactatttaaattggatcagcaagaaaccaggaaacgcccctaagcctcngatctatgctacttcctagtttgacgtaaaggtcgggtacctagaaggttcaggtgctaggtggtatcgtagggactagtactttcactctcacctactccgtacggtcttcgacctaaaccgtgtaaacgtactttcgaactaaacctttactaactacgttaaccaaaccagttaaccttactaaccggttccccgaccccccgtaatccccgtaaacccgtttccgggaacccgaaacgggggaccaaaccggtacggttaacgggaaactaaaacgtttaaaaccggaaaccgtggttaccggaccttacggaacctaccctaaagttccttgtttacccttactaactttcccccg

SEQ ID NO: 308029 - DNA, 663 bp, Homo sapiens
  misc_feature: GZ8MTXP02J1BP7.22.65.F10.1.454.CMB.2.raw
  modified_base (276)..(276): a, c, t, g, unknown or other
  misc_feature (276)..(276): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatcacctgccgggcaagtcagagcaattaacgtacttaatttaaatggtatcagcgaagaaaccgaggaaacncccctaagctctgatctatgactacttccagtttgacgtaaaggtcgggtaccctagaacggttcacggtggacaggttggactcgtaggggaccaggtactttaccacttcctacctaaccacgtcccggcggttcctacggacctaaaccgtagtaaacgtactttaccggaaccttaaacctttaccgtaacgttagttaaccaaacgtacgtaacctttaccgaacgttccccgaccccctagttaccctaccgttacggacccgaaaggggacccaacggtaccgtagggaaactaaacgttaaaacccggacgttacggtacgggaccttacggcctaacccgtaacgttccgttacgtttcttacccgtacgtttccccg

SEQ ID NO: 308030 - DNA, 690 bp, Homo sapiens
  misc_feature: GZ8MTXP02IDDPZ.22.65.F10.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtagganacagagtcaccatcacctggccggnagtcagagcaataacgtacttaatttaaagttggtatcagcaagaaaccgagggaaacncccctaagcctcctagatctatcgacttacttccagtttgacgtaaaggtcggggtaccctagaaggttcagtggctaggtggatcgtagggatagtatttccgactctacacctacgtcccgcggtctacgacctaaccgtagtaaagttactttacgaacctaaaccgtttaaccgtacttacggttaacctaaaccgtaaacgttaacctttaaccgaccggttacccccgaccccccccggtaactttacccgttaacccggtttacccgggaaccggtaaaccggggtaacccgaaaccggtaaccgttaggggaaacgtaaacgtttaaaaacccggaagttacggttacgggaccttaggaaccctaccgtacttacgttcgtttacccttactaccgtttaccccg

SEQ ID NO: 308031 - DNA, 685 bp, Homo sapiens
  misc_feature: GZ8MTXP02H8AEZ.22.65.F10.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (374)..(374): a, c, t, g, unknown or other
  misc_feature (374)..(374): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacctggccggnaagtcaagagcaataacgtacttaatttaaattggtatcagcaagaaacaggaacnccctaagctcctgatctatcgacttacttccgtagtttacgacgtaaagggtcgggtaccctagtaaggttcaggtggacaggtcggatcgtgggactagtntttccactctacactacgtccgtcgtctcgaccgtaaacctagtaaacgttactttacgaccttaaacttactacgttacgtaacctaaaccgtaacgttaaccgttaaccgtaccggttaccccgaccccccccgtacgtacccgttaaccccgttaccgggaacccgaaaacggggaacccgaaccggtaaccggtaacgggtaaacggttaaaacgttaaaaaccggtaaaccgtacgggttaccggtccgtaccggaaccctacccgttaacgttccttacgtttcccttacttacccgtttccccg

SEQ ID NO: 308032 - DNA, 603 bp, Homo sapiens
  misc_feature: GZ8MTXP02HWC9G.22.65.F10.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctggccggganaagtcagancaataacgtatatttaaattgatcagacagaaacaggaacnccctaagctcngatntatgctacttcagtttgacgtaaggtcgggtcctagtaaggttcaggtggactaggtggattcggagggtactagtactttcacctctaccactactccgcggtctcgacaaccgtagtaacgttactttccgaactaacctttactactcgtacaacacgtaaccttacgaccgtcccgacccccgtataccctaccgttaccgggaccgtaaacgggaccgtaacggtacgtaggaaacgtaaacgttaaacggaacgttcggtacggtacctacggaaccctacctaacttcgttacgttcctttacctactttccccg

SEQ ID NO: 308033 - DNA, 586 bp, Homo sapiens
  misc_feature: GZ8MTXP02FWJ6G.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancataacgtactaatttaaattgtatcagacaagaaaccgagggaaacnccccctaagcctcctagatctatgctacttcctagtttgacgtaaaggttcggggtccctagaaggttcagtggcaggtggatcgtagggactagtatttcactctacaccactccgcgtctcgacaacgtagtaagtattacgactaacttactactacgtacaaactacgtacttacgacgtacccgaccccccgtatacctacccgttaccggacccgaacgggaccgaaccgtacgtaggaaacgtaaacgttaaaacgaacgtacggtacgacgtacgaaccaccgtactctcgtaccttcactttcccc

SEQ ID NO: 308034 - DNA, 680 bp, Homo sapiens
  misc_feature: GZ8MTXP02FXAN8.22.65.F10.1.454.CMB.2.raw
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtactaatttaaattggtatcagcaagaaacaggaaacncccctaagctcngatctatgcctacttccagtttgacgtaaagggttcggggtaccccgtagtaaacgggtttcgaaggttgggacctaggttcgggtaattccggtaggggtacctaggttaacttttaccaaccttcctaccaacccgtacgttcccggtccgggttcctacgtacctaaacccgtagtaaacgtactttaccgaacttaaacctttaacttaacgttacgttaaccaaactaacgtaaccttaaccgaaccggttacccgacccccccgtatacccgtacccgttaccggaccgaaacgggaccgaacggtaaccgtagggaaacgtaaacgttaaaacgtaacgttggtacggtcgtacgaaccgtacctatccgtgttccttactactttccccg

SEQ ID NO: 308035 - DNA, 589 bp, Homo sapiens
  misc_feature: GZ8MTXP02HH2TE.22.65.F10.1.454.CMB.2.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
  modified_base (386)..(386): a, c, t, g, unknown or other
  misc_feature (386)..(386): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacctggccgggnaagtcagagacaataacgtacttaatttaaattggtatcagacaagaaaaccgagggaaacacccctaagcctactgatctatgactacttctagtttgacgtaaaggtcgggtcccgtanaaaggttcaggtgctagtgatcgtgggacagtatttcactctcaaccntccgcgtctgaccaacgtagtaacgtacgtttcaacttaaacttactaactacttaaccaaactaacgtaaccttacgtaccggtacccgaccccccgtatacccgtacccgttaccgggaaccgaaacgggaccaacggtacgacggtaacgtaaactaaaacgaactggtcgactgaacactactcgtctctctacttccc

SEQ ID NO: 308036 - DNA, 545 bp, Homo sapiens
  misc_feature: GZ8MTXP02GCNAG.22.65.F10.1.454.CMB.2.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (423)..(423): a, c, t, g, unknown or other
  misc_feature (423)..(423): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacgatcccagatcgacccagtccgtccagtccctaccgtgtcctagcatctgtaggagacagagtcaccatcactgccggnaagtcagagcaataacgtactaatttaatggatcagcagaaaccgaggaacncccctaagcctcctgatctatgtactacttcagtttcgacgtaaggttcggggtaccctagtaaggttcaggtgactaggtgatcgtagggnagtacttcactcgacacgntccgngtctgcactgaatcttacactattactactanacactactactacgacgtacccgaccccactaccgtaccgtacgaccgaacgacacgacgtagaacgtaacgtaaacgacgtacgtacgcgtacgaacgtactactctctcttactactccg

SEQ ID NO: 308037 - DNA, 580 bp, Homo sapiens
  misc_feature: GZ8MTXP02F63G0.22.65.F10.1.454.CMB.2.raw
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatgtatcagcaagaaacaggaaacncccctaagcctctgatctatgctactttccagtttgacgtaaaagggttcggggtacccctacgtaaagggtttcaaggtcggcaggtggtatcgtgggacagtatttcactctcactactccgcgtctgacaactagaagtactttcgactaacttactactacgtacaaacacgtacttacacgtccgaccccccgtatacctacccgttacggaccgaaacgggaccgaacgtacgtacggaaagtaaacgtaaaacggaaacgtcgtacgcgtacgaacctaccactcgtcgttacttaccactttcccg

SEQ ID NO: 308038 - DNA, 544 bp, Homo sapiens
  misc_feature: GZ8MTXP02FLC9N.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaatggtatcagcaagaaaccagggaaagcccctaagctcctgatctatgctacttccagtttgactaaaggtcggggtcccgtagaaacggttcaggtggcaggttggatcgtaggggacagtatttcactctacaccatccgcgtactgacaactgaacgtattacgactaacttactactagtacaaacagtacttacacgtaccgaccccccgatccaccttcggaccaaagggacaacgacgtaggaagaattaaaacgaaactcgtaggcctgaacacctatctgtcttacacttcccg

SEQ ID NO: 308039 - DNA, 775 bp, Homo sapiens
  misc_feature: GZ8MTXP02IFW04.22.65.F10.1.454.CMB.2.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtagganacagagtcaccatccacctggccggganaagtcagagctaataacgtactaattttaaattggtatcagcaagaaaccagggaaacncccctaagcctcctgatctatgactacttcctagtttgactaaaggtcggggtcccctacgtaaaggttcaggtcggcgtacgtgggaattcgtggggacctagttatttccgacttccgtaccaacctactccccggtacggtccgtacgacccgtaaacccgtagtaaacggttacttttaccggaaccttaaacctttacctaacgttacggtaaccctaaaaccgtaaacgtttaaaccgtttaaacccgtaccgggttacccccggtaccccccccccggtaattaccccgtaaccccggttttaacccggggaccccgtaaaaccgggggaacccgtaaacccggtaaaccggtaacgggtaaaacgggttaaaccgttttaaaaaaccgggaaaccggtttacgggtaccggggttacttaccgggaacccgttaaacccgtaacgttcctttaccggtttaccctttaacctaaccttttaaccccccg

SEQ ID NO: 308040 - DNA, 660 bp, Homo sapiens
  misc_feature: GZ8MTXP02IFT6U.22.65.F10.1.454.CMB.2.raw
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
  modified_base (651)..(651): a, c, t, g, unknown or other
  misc_feature (651)..(651): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctggtaggagacagagtcaccatccacctggccgggacaagtcagagacaataacgtattaatttaaattggtatcagcagaaaccaggaacncccctaagctctgatctatcgacctacttcctagtttgacgtaaagggttcggggtacctagtaaggttcaggtgacgaggttggacttcggngggtacctagttactttaccaccttcctacaccgtacgttcccgtcggttcctacgtacccgtaaaccgtagtaaagttctttacgaccttaaaaccttactaacttacgtaacctaaactacggttaaccttaaacgcggttaccccgaccccccgtaattccctaacccggttaccgggaccgaaaacgggaccgaacggacgtagggaaacgtaaaacgttaaaaccggaaacttgggtacggtcctacgaaccgtaccgtattccgttagttccctttacncctttcccg

SEQ ID NO: 308041 - DNA, 591 bp, Homo sapiens
  misc_feature: GZ8MTXP02IUSVR.22.65.F10.1.454.CMB.2.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (393)..(393): a, c, t, g, unknown or other
  misc_feature (393)..(393): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagcaataacgtatattaaattggatnagcaagaaaccgaggaacncccctaagcctctgatctatgccttacttccgtagtttcgacgtaaagggtcggggtaccctagtaaggttcaggtggacgtagtggatcgagggcagttattcactcacaccactccgtcgtcncgacacctagagtacttacgactacttactactagtacaacagtactacgtacgtacccgacccccgtactacctaccgttccggaccgtaacggaccaacggtaacgtaggtaaacgtaaacgttaaaacgaacgttacggtacggtacgttacgaaccgtaacgtacttccgtcgttaccttactacctttccccg

SEQ ID NO: 308042 - DNA, 606 bp, Homo sapiens
  misc_feature: GZ8MTXP02G9Z1N.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacctggccggnaagtcagancaataacgtaacttaatttaaattggtatcgagacaagaaaccgaagggaaacncccctaagcctacctgacttctatcgtactacttcctagtttacgacgtaaagggtcggggtaccctagtaaacggttcaggtggactaggtaggatcgagggactagtactttacacctctacacctatccgcggtctgacaaccgtagaagtacttacgtactaaacttactacttacgtacacaacgtacttacacgttacccgacccccgactaccaccgttcgaccgaacggacgaacgtacgtaggaacgaaacgttaaaacgaaccgttggacggtactacgaaccgtactacttcgtacgttaccttacctacttaccccg

SEQ ID NO: 308043 - DNA, 614 bp, Homo sapiens
  misc_feature: GZ8MTXP02JX5WK.22.65.F10.1.454.CMB.2.raw
  modified_base (286)..(286): a, c, t, g, unknown or other
  misc_feature (286)..(286): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtaggagacagagtccaccatccaccgtggccgggacaagtcaggagactaataacgtacttaatttaaagtggtatcagacaagaaaccgagggaaaccnccccgtaagcctccagtactctatcgaccttacgttccgtaggtttcgacgtaaggtccggggtaccctagtaaggttcaggtgactaggtagagtcgagggactagtactttccgacttctaccacctacgtccgtcgtctcgacaacgtagaacgtacgttacgactaacttactactagtacaacgtacgtactacgacgtccgacccccgtataccgtaccgtcggaccgtacggaccacggtacgtaggaacgtaacgtaaacgacgtacggtacgtaccgtacgaaccgtactacgtcgttacgtacttacctactttcccg

SEQ ID NO: 308044 - DNA, 634 bp, Homo sapiens
  misc_feature: GZ8MTXP02JFBUT.22.65.F10.1.454.CMB.2.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtccaccatcaccgtggccgganaagtcagagcaataacgtactatttaaatggtatcagcaagaaaccaggaaacncccctaagctacctgatctancgctactcctagtttnacgtaaaggtcggggtacccgtagaaaggttcaggtcggctaggtggagtccgaggggacctaaggtacttttccgaaccttccgtacctaaccctacgtccccggtaccgggttccttacggaccctaaacccgtaggtaaagttacgtttaccgtacctaaactttacctaacttcgtaacctaaacacgtacttacgacgttcccgacccccgataccctacccgtaccggaccgaacgggacacgacgtaggaactaaacgtaaaacgacgtacgtacggctacgaaccacctaatcctgttaccttactactttccccg

SEQ ID NO: 308045 - DNA, 530 bp, Homo sapiens
  misc_feature: GZ8MTXP02FP675.22.65.F10.1.454.CMB.2.raw
  modified_base (324)..(324): a, c, t, g, unknown or other
  misc_feature (324)..(324): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccgggcaagtcagagcataacgtactatttaaatggtatcagcagaaaccaggaaacgcccctaagctcctgatctatgctacttccagtttgacaaaggtcggggtacccgtnaaggttcagtgcagtggatcgtgggacagtatttcactctcaccatccgcggtctgcaactagaagatttcgactaacttactactagtacaaacagacttacacgtccgaccccccgatccaccttcggaccgaaggacacgacgtaggagtactaaacgactacgcgtcgtacgaacgactactcgtactcttacactttcccg

SEQ ID NO: 308046 - DNA, 586 bp, Homo sapiens
  misc_feature: GZ8MTXP02FSD5B.22.65.F10.1.454.CMB.2.raw
  modified_base (274)..(274): a, c, t, g, unknown or other
  misc_feature (274)..(274): n is a, c, g, or t
  modified_base (391)..(391): a, c, t, g, unknown or other
  misc_feature (391)..(391): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggcaagtcagagcaataacgtacttaatttaaatggtatcagacaagaaaccgagggaaacncccctaagcctcctgactctatcgacttacttccgtagtttgactaaagggttcggggtccctagtaacgggttcaggtggacagtggatcgtgggacagtactttcactctcactntccgcgtctgacactagagtacttacgactaacttactactagtacaactagtacttacacgtcccgacccccgtatccctaccgttacggaccgaacgggaccgacgaacgtaggaaacgtaaacgttaaaacggaacgtaggtacgtacgtacgaaccgtaccgtacttactcgttaccttactactttcccg

SEQ ID NO: 308047 - DNA, 662 bp, Homo sapiens
  misc_feature: GZ8MTXP02GECFY.22.65.F10.1.454.CMB.2.raw
  modified_base (286)..(286): a, c, t, g, unknown or other
  misc_feature (286)..(286): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtccaccatccaccgtggccgggacaagtcagagcaataacgtacttaatttaaagttggtaatcagacaacgaaaccgaggggaaaccncccctaagcctacctgactctatcgtcttaccttcctaggtttcgacgtaaaagggttcggggttacccctagtaaacgggtttcaaggtcggactaggtggtatcggtagggacagtactttcactctcacctacgtccgtcggtactcgaccgaacttagaacgtactttacgacttaaacttactactagtaccaaacgtacgtaccttacgtacgtaccccgaccccccgtatacccgtaacccgttccggaaccgaaacggggtaccaacggtaacggtacgggtaacgtaaacgttaaaacggacgttacgttacgggccttaacggaacccgtaacacttaccggttcgtaccttcgtaactttccccg

SEQ ID NO: 308048 - DNA, 551 bp, Homo sapiens
  misc_feature: GZ8MTXP02GKA1A.22.65.F10.1.454.CMB.2.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
  modified_base (456)..(456): a, c, t, g, unknown or other
  misc_feature (456)..(456): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtcctgcatctgtaggagacagagtcaccatcacctggccgggnaagtcagagcaataacgtactaatttaaattggtatcagcaagaaaccaggaaacncccctaagctcctgatctatgctacttccagtttgactaaggtcggggtaccctagaaggttcaggtgcaggtgatcgtagggactagtactttcactcctacacctatcccgcgtctcgacaacctagtaagtactttacgactaacttactactcgtacaacacgtactacacgtacccncccccgatccaccgttcgaccgaacggacacgtacgtaggataacgttaaacgactggtacgcgtacgaacacctatctcgtctactacttcccg

SEQ ID NO: 308049 - DNA, 632 bp, Homo sapiens
  misc_feature: GZ8MTXP02G164C.22.65.F10.1.454.CMB.2.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatcaccgtgccgganaagtcagagacattaacgtacttaatttaagtgtatcagacaagaaccgaggaacncccctaagcctactagactctatcgtactacttcctagtttcgacgtaaggtccgggtacctagtaagttcaggttgacgtaggtgtacgtcgagggactagttacttaccaccgttcctacaaacccgtgttcccgtcgttaccgtacggtacctaaccgtaggtaacgttacgtttaccgaaccttaaaccttacttaacttacgtaacctaacgtaacgtacttaaccgtaccgttaccccgacccccgtacttacccgtaccgttaccggaccgaacgggtaccaacgtacgtaggaacgtaaacgttaaacgacgttcgcgctacgctacgtactcgttctcttacctactttcccg

SEQ ID NO: 308050 - DNA, 652 bp, Homo sapiens
  misc_feature: GZ8MTXP02HCG7A.22.65.F10.1.454.CMB.2.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacctggccgganaagtcagagcataacgtatattaatgatcagacaagaaaccgaggaaacncccctaagcctctgatctatcgtacttacttccgtagtttcgacgtaaggtcgggtacctagaaggttcaggtgctaggtgatcgtagggactagtactttacgactctacaccgtacgtccgtcgtctacgactaaccgtagtaaacgttacgtttaccgaaccttaaacttactacgttacgtaacctaaacgtaacgttaaccttaccgtaccggtaccccgaccccccgtactacccgtacccgttaccgggaacccgtaaacgggaccgaaccggtaacggtacgggtaaacgtaaaccgttaaaacggaacgttacggtacggtcgttacgaacccgtaacgtacttccgttacgttacctttaccgtacctttccccg

SEQ ID NO: 308051 - DNA, 601 bp, Homo sapiens
  misc_feature: GZ8MTXP02GDD75.22.65.F10.1.454.CMB.2.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctgccggnaagtcagagcaataacgtacttaatttaaattggtatcagacaagaaaccgagggaaacncccctaagcctcctgatctatcgctacttccagtttgacgtaaaggtcggggtaccctagtaaggttcaggtggcaggtggatcgtagggacagtactttcacttcctacacctacgtcccgtcggttcctagacctaaccgtagtaagtactttccgtactaaacttactactacgtacaacgtacgtacttacgacgtacccgaccccccgtatacctaccgttaccggaccgaacggaccgacgtacgtacggaagtaaacgttaaacgtacgtacgtacggctacgaacctacgtacttctacgttccttactactttcccg

SEQ ID NO: 308052 - DNA, 659 bp, Homo sapiens
  misc_feature: GZ8MTXP02JU5LG.22.65.F10.1.454.CMB.2.raw
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacctggccggacaagtcagagcataacgtattaatttaaatgtatcagcaagaaaccgaggaacncccctaagcctactagatctatcgacttacttccgtagtttgacgtaaggtcggggtaccctagtaaggttcaggtcggacgtaggtggactcgtagggactagttactttccactctaccaaccgtacgtcccggtcggttcctcgacctaaccgtagtaacgttactttaccgaacttaaaccttactacttacgtaaccaaacgtaacgtaccttaccgaccggttacccccgaccccccgtattaccccgtaacccgttccgggaacccgaaacgggaccgaccgaacggtacggaacgtaaaccgttaaacggacgttacgggtacggtacctcggaaccctaccgtacttccgttacgtttaccctttcctacgtttcccccg

SEQ ID NO: 308053 - DNA, 631 bp, Homo sapiens
  misc_feature: GZ8MTXP02GF0CW.22.65.F10.1.454.CMB.2.raw
  modified_base (390)..(390): a, c, t, g, unknown or other
  misc_feature (390)..(390): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtaggagacagacgtccaccatccaccgtggcccgggacaagtcaaggagactaattaacgtacttaatttaaagttggtatcagacgaacgaaaccgaagggaaaccgcccctaagcctcctgattctatcgccttacttcctagtttcgacgtaagggtccgggtacctagtaaggttcagtggacaggtggctcgtgggacngttactttccaccttctaccacctacgtcccggtcgtctcgacctaaccgtagtaaacgtctttacgaacttaacttactactacgtacaaactacgtacttacgaccgtccccgacccccgtatacccgtaccgttaccgaccgaacgggaccaacggtacgtagggaactaaacgttaaacgacgttcggtacggtctacgaaccgtacctacttcgtacgttactactacctttcccg

SEQ ID NO: 308054 - DNA, 577 bp, Homo sapiens
  misc_feature: GZ8MTXP02GL8MZ.22.65.F10.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacctgccgggnaagtcagagcaataacgtacttaatttaatggtatcagcaagaaaccaggaaacncccctaagctctgatcatgctacttctagtttgactaaggtcggggtacctagaaggttcaggtgcagtggatcgtagggactagtactttcacttctacaccactccgcgtctcgacaactagaagtactttacgactaacttactactgtacaacacgtacttacacgtcccgacccccgtatccaccgttcggaccgaacgggaccaacggtacgtacgggaacgtaaacgttaaaacgacgtacggtacgacgttcgaaccgtacctacgttccttacgttacctttacctacgtttccccg

SEQ ID NO: 308055 - DNA, 562 bp, Homo sapiens
  misc_feature: GZ8MTXP02GHQLG.22.65.F10.1.454.CMB.2.raw
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtactaatttaaatggtatcagcaagaaaccaggaaacncccctaagctcctgatctatgctacttccagtttgacgtaaaggttcggggtaccctagaaaggtttcaggtggctagtggatcgtgggactagtactttcactctacaccatccgcgtctgacaactgtaagtactttcgactaacttactactagtacaaactacgtacttacacgtccgaccccccgtatccgtaccgttcggaccgaaacgggaccaacggacgttacggaagtaaacgttaaaacgacgtcgtacggctagaacactactctgtcttacactttccc

SEQ ID NO: 308056 - DNA, 683 bp, Homo sapiens
  misc_feature: GZ8MTXP02H6OYN.22.65.F10.1.454.CMB.2.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccactccctcctgtctgcatctggtagganacagagtcaccatccacctggccggganaagtcagagctaataacgttacttaatttaaagttggtatcgaagaccaaacgaaaaccgaaggggaaacctccccctaaagcctacctagattctatcgtaccttaccttctaggtttgacgtaaggttcggggtaccctagtaaggttcaggtcggactaggtggtatcggtaggggactaggttactttaccgaccttcctaccaaccgtacgtcccggtacgtcctcgaacctaaccgtaggtaaacgtttacctttcgaaccttaaacctttacgtaacttacgtaaaccaaacgtacgttaaccttaaccgaccgttacccccgaccccccgtatcccgtacccgttccggaaccgaacgggtaccaacgtacggtaggaaacgttaaaccgtaaaacggacgttggacggtcacgaacctacgtacgttaccgtgtttaccttacttactccccg

SEQ ID NO: 308057 - DNA, 573 bp, Homo sapiens
  misc_feature: GZ8MTXP02GNCF9.22.65.F10.1.454.CMB.2.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcacatcactgccggnaagtcagagnataacgtactaatttaaatggtatcagcaagaaaccaggaaacncccctaagcctctagactctatcgtaccttacttcctaggtttcgacgtaaagggttcggggtacccgtagtaaaggttcaggtggactagtggatcgagggactagtactttcactcacactacgtccgcgtctgaccacgtagtaatcttacgactaacttacgtactacgtacaaactactactactaccggtacccgacccccgtatacctaccgtacggaccgaagggaccacgacgtagaacgtaaactaaacgactcggtacgcgtacgaaccgactacgtactcgtctacacttcccg

SEQ ID NO: 308058 - DNA, 551 bp, Homo sapiens
  misc_feature: GZ8MTXP02JJX3Z.22.65.F10.1.454.CMB.2.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggnaagtcagagcataacgtactatttaaatgtatcagcagaaaccaggaaacncccctaagctctgatctatgctacttcctagtttgactaaaggtcggggtccctagaaggttcaggtggcagtggatcgtgggactagtatttcacttctacaccacgtcccgcggtctacgactaacctgaacgtactttcgactaacttactacttagtaccaaacacgtaccttacacgtacccgacccccgtatacccgtaccgtcgaccgaacgggacacgacgtagagtaactaaacgacgtcgtacgctacgaaccactactactcgtcttacacttcc

SEQ ID NO: 308059 - DNA, 630 bp, Homo sapiens
  misc_feature: GZ8MTXP02FWPUZ.22.65.F10.1.454.CMB.2.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
  modified_base (388)..(388): a, c, t, g, unknown or other
  misc_feature (388)..(388): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacctggccggganaagtcagagcaataacgtacttaatttaaattggtatcagcaagaaaccgagggaaacncccctaagcctcctgatctatcgctacttcagtttgacgtaaaggttcggggtccctagtaaggttcaggtggcaggtggatcgtagggactagactttcactctacaccngtccgcgtctgactaacctgtaatacttacgactaacttactactacgtacaaactaacgtaccttaaccgacgtaccccgtaccccccgtactacccgtacccgttaccgggaccgaaacgggaacccgaacggtaacgtacgggtaaacgtaaacgttaaaaccggtaacgttacgggtacggaccgtacggaaccgaaccgtaacttaccgttcgtttaccttacctaactttcccccg

SEQ ID NO: 308060 - DNA, 696 bp, Homo sapiens
  misc_feature: GZ8MTXP02JHMC3.22.65.F10.1.454.CMB.2.raw
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccaccgtggccggganaagtcagagactaagtaacgtacttaatttaaagttggtatcagacaacgaaaccgaaggaaacncccctaaagcctacctttagacttctatcgtactacttctagtttagacgtaaaggtcgggtaccctagtaaaggttcagtggactagtggtacgtcgtgggactagttacttccgaactctacctaacctacgtacccgtcggttctacgactaacgttagaacgttacttaccgtactaacgtttactactacgtaacctaaacgtaacgtaaccgttaaccgaccggttacccccgaccccccgttaacgtaccccgtaacccgtttaccggaacccgaaacgggtacccgaaaccggtaaccggtaacgggaaacgttaaaaccggttaaaaccgaaacgttcggtaaccggtacctacggaaccctaccgtaacttccgttacgttacctttactacctttaccccg

SEQ ID NO: 308061 - DNA, 537 bp, Homo sapiens
  misc_feature: GZ8MTXP02GJ54W.22.65.F10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacctgccggnaagtcagagcaataacgtactatttaaatgtatcagcagaaaccaggaaacncccctaagctcctgatctatgctacttccagtttgacgaaaggttcggggtccccgtanaaacggttcaggtggcaggtggatcgtggggactagtactttcaccttctacaccatccgcgtctcgacaacctagaagtatttcgactaacttactactacgtacaacagacttacacgtccgacccccgactcaccgttcggaccgaacgggacacgactaggagaacgttaaacgaactgtacgctagcacgctactgtcttcacttccc

SEQ ID NO: 308062 - DNA, 638 bp, Homo sapiens
  misc_feature: GZ8MTXP02HRMKN.22.65.F10.1.454.CMB.2.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaccgtggccgggcaagtcagagcaataacgtattaatttaaatggtatacagacaagaaaccgagggaacncccctaagcttccngtatctatcgcttacttccgtagtttgacgtaaaggtcgggtacctagaaggttcaggtgactaggtggatcggtagggctagttactttaccacttccacacctacgtcccgtcggtactacgtacctaaccgtagtaaacgttactttaccaccttaactttacttaacgtagtaacctaaactaacgttaaccttacgtaccgttaccccggaccccccgtaacttacccgtaacccgttccgggaaccgtaacgggaaccacggtacgtaaacggaagtaaacgttaaaacggtacgtcggtcggtctacgaaccaccgtatcttacttccttactccttccccg

SEQ ID NO: 308063 - DNA, 563 bp, Homo sapiens
  misc_feature: GZ8MTXP02HIZ2D.22.65.F10.1.454.CMB.2.raw
  modified_base (268)..(268): a, c, t, g, unknown or other
  misc_feature (268)..(268): n is a, c, g, or t
  modified_base (538)..(538): a, c, t, g, unknown or other
  misc_feature (538)..(538): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcaataacgtatattaaatggtatcagcaagaaaccgaggaaacncccctaagcctcctagatctatcgtactacttccagtttcgacgtaaaggtcgggtaccctgtaaacggttcaggtcggcagtcggaatcggtagggacagttactttaccacttctaccaccgtactccgtcgtctacgacaacctagaagttacttcgactaacttactacgtatactaacagtacttacacgtcccgccccgtactccgtaccgttcgaccgtaaggacacgacgtacgagtaaactaaacgactcgtcgacgtacncactacgtctagtctcgtacttccg

SEQ ID NO: 308064 - DNA, 592 bp, Homo sapiens
  misc_feature: GZ8MTXP02GTGUJ.22.65.F10.1.454.CMB.2.raw
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgatccagtctccatcctccctgtctgcatctgtaggagacagatcaccatcactgccggnaagtcagancaataacgtactatttaatggtatcagacaagaaaccgaggaaacgcccctaagctctgactctatcgtacttacttcgtagtttcgacgtaaagggtcggggtccctagtaaggttccgaggtcggactaggtggtatcgtggggacaggtaactttcaccttctaccacctacgtccgtcggtactcgacctaaccgtgaacgtactttccgaactaacttactaacgttacgtaacaacgtacgaacttacgaccgtcccgacccccgtatcccgtaccgtaccggaccgaaagggaccaacggacgtaggtaactaaacgttaaacgaccgtgtacgactcgtaccacgtactctacttcctactcc

SEQ ID NO: 308065 - DNA, 627 bp, Homo sapiens
  misc_feature: GZ8MTXP02I17D3.22.65.F10.1.454.CMB.2.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcaccgtgccgggnaagtcagagcaataacgtataatttaaatgtatcagacaagaaaccagggaaacncccctaagcctctgatctatcgtccttacttccgtagtttgacgtaaagggttcggggtaccctagaaaggttcaggtcggactaggtggatccgtaggggactagttactttaccacttaccgaccaaccgtacgtcccgtcggttcctacgtacctaaccgtagtaaacgtctttacgactaacttactactagtactaaacacgttacttacgacgtaccccgacccccgtatcccgtaccgttcggaccgaaggacgacgacgtagggaactaaacgttaaacgacgttacggtcggtacctacgaacctaccgtaacttccgttacgttcctttacctacctttcccccg

SEQ ID NO: 308066 - DNA, 572 bp, Homo sapiens
  misc_feature: GZ8MTXP02I8RCG.22.65.F10.1.454.CMB.2.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (262)..(262): a, c, t, g, unknown or other
  misc_feature (262)..(262): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacntcactgccggnaagtcagagcataacgtacttattaatgtatcagcaagaaacgaggaacncccctaagctctgatctatgctacttcagtttgactaaggtcgggtaccctagtaaaggttcaggtgactaggtggatcggagggacagtactttcactctacacctacgtcccgtcggtctcgacctaactagtaacgtcttacgacctaacttactaactacgtacctaaacgacgtactaccgtacgtacccgaccccctagtacccgtaccgttaccggacccgaaacgggacgaaccgtacgtaggaaataacgttaaaacgaacgtgtcgactagaaccgactacgtctctctactacttcccg

SEQ ID NO: 308067 - DNA, 507 bp, Homo sapiens
  misc_feature: GZ8MTXP02FPHO5.22.65.F10.1.454.CMB.2.raw
  modified_base (190)..(190): a, c, t, g, unknown or other
  misc_feature (190)..(190): n is a, c, g, or t
  modified_base (316)..(316): a, c, t, g, unknown or other
  misc_feature (316)..(316): n is a, c, g, or t
  modified_base (422)..(422): a, c, t, g, unknown or other
  misc_feature (422)..(422): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggcaagtcagagcataacgtactattaaattggtatcagcagaaaccaggaaagcccctaagctcctgatctatgctacttcagtttgcaaagtgggtcccgtnaaggttcagtgcagtggatcgtgggcagatttcgactctcaccatccgcggtctgcaacctgaagatttcgactaacttactactgtacaacagacttacacgtcnccccccgatcaccttcggcctaacggacacgactaggagacgttaaaacgaactgtacggctagcacacgtctgtactcattccc

SEQ ID NO: 308068 - DNA, 604 bp, Homo sapiens
  misc_feature: GZ8MTXP02FRIP2.22.65.F10.1.454.CMB.2.raw
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatccacctgccggnaagtcagagcataacgtacttaatttaagtggtatcagcaagaaaccagggaaacncccctaagctctgatctatncctacttcagtttgacaaggttcgggtcccgtnaaaggttcaggtggacaggtggactcgtagggactagtactttcacttcgtacacctctcgcgtctcgacaactgaacgtctttaccgactaaccttactacgtcgtaaccaaacacgtaccttaccgacgtccccgaccccccgtaatcccgtaacccgttccggaacccgaaacgggccgaacggtaaccgtaggggaaacgtaaacttaaaaccggaacgtggtaacggcgttacgaaccaaccgtaactcgttacgtccttactacctttccccg

SEQ ID NO: 308069 - DNA, 558 bp, Homo sapiens
  misc_feature: GZ8MTXP02IZUWP.22.65.F10.1.454.CMB.2.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcactgccggnaagtcagncaataacgtactaatttaatgtatcagcaagaaaccagggaaacgcccctaagcctcctgatctatcgacttacttccagtttcgactaaggtcggggtcctagaaggttcagtgacagtgatcgtgggactagtactttcactctacacctactccgcgtctgacaacctagaatcttacgactaacttactatacgtacaacagtacttacgacgtacccgacccccgtatcctaccgttaccggacgtaacggacaacggacgtaggaacgtaacttaaacgacgtcgtacggctacgaacgactacttctacgttaccttactactttccccg

SEQ ID NO: 308070 - DNA, 565 bp, Homo sapiens
  misc_feature: GZ8MTXP02JIQ6W.22.65.F10.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccgggnaagtcagagcataacgtactatttaatggtatcagcagaaaccaggaaacncccctaagctacctgatctatgccttacttccagtttcgactaaaggtcggggtaccctagaaggttcaaggtgactagtagatcgtagggactagtatttccactctacaacctactccgtcgtactcgacaaccgtgaacgtacttacgactaacttactactagtactaacagtactacacgtcccgacccccgataccaccgttacgaccgaacggacacgtacgacggaagtaacgtaaaacgacgttacgtacgacgtacgaacactacgtactacgtccttactacttcccg

SEQ ID NO: 308071 - DNA, 586 bp, Homo sapiens
  misc_feature: GZ8MTXP02GNIC8.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcactggccggnaagtcagagcaataacgtacttaatttaatggtatcagcaagaaaccagggaaacgcccctaaagctcctgatctatgctacttccagtttgacgtaaaggtcggggtaccccgtagtaaacggttcaggtggactaggtggattcgtaggggacagtatttacaccttctacaacctactcccgcgtctcgactaacctagtaacgtactttacgactaacttactactagtacaaactaacgtacttaacacgtcccgaccccccgtataccctaccgtaccggaccgaaacgggaccaacgtacgtacggaaagtaaacgtaaaacgtaacgtgtacgctacgaacactactctctactctacttcccg

SEQ ID NO: 308072 - DNA, 590 bp, Homo sapiens
  misc_feature: GZ8MTXP02JL0SB.22.65.F10.1.454.CMB.2.raw
  modified_base (256)..(256): a, c, t, g, unknown or other
  misc_feature (256)..(256): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatccaccgtggccgggacaaggtcagagacataacgtattaattaaatggtatnagacaagaaaccgaggaaacgcccctaagcctactgatctatcgtcttacttctagtttcgacgtaagggtcgggtaccgtagtaggttcgaggtcggacgtaggtggagtcgtagggactagtacttcgacctctaccgacctacgtccgcgtctacgacctaactagaacgtacttacgactaacttactactacgtacaacgacgtaacctacaccgtacccgacccccgatcccgtaccgtaccggaccgtaaacgggacacgacgtaggataaacgtaacgtacgtcggtacgcgtacgaactacgtactcgtctcctactacctcccg

SEQ ID NO: 308073 - DNA, 622 bp, Homo sapiens
  misc_feature: GZ8MTXP02IETY2.22.65.F10.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctggtagganacagagtcaccatcacctggccgggnaagtcagagactaataacgtattaatttaaattgatcagacaagaaaccgaggaacacccctaagcctcctagactctatcgtaccttacttcctaggtttcacgtaaaggtcgggtacccctagaacggttcaggtgactggtgatcgagggctagtattccactcctacaccctacgtcccgtcggtctcggaacctaaccgtagtaaacgttactttccgtaactaaacctttacacgttacgtaactaaccaacgttaactactaccgtaccccgacccccgtattaccctacccgtaccggaaccgaaacgggaccaacggtaccgagggtaaactaacgttaaaaccggagttcggacgtcacgaacctactacgttcgtacttccttactacttccccg

SEQ ID NO: 308074 - DNA, 601 bp, Homo sapiens
  misc_feature: GZ8MTXP02G8Z9F.22.65.F10.1.454.CMB.2.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (483)..(483): a, c, t, g, unknown or other
  misc_feature (483)..(483): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtaggagacagacgtccaccatccaccgtgccgggacaagtcagagacaataactataatttaatgtancagnaagaacgaggaacncctagctcngatctatcgctacttctagttcgacgtaaggtcggggtacctagtaaaggtttcaagggttcggacgtaggtacggtacgttaggaggggacctaaggttactttaccaaccttcctaacctacctacgtcccggtacgtccgtacgaccgtaaccgtagtaaacgtaccttacacttaaacttactacgtactactaaacncgtaactaccgacggtcccccaccccgtatccctaccgtcggaccgaaggaccacgtagacggaagtaaacgtaacgacttgacgtctacgcacgtactctagtctacgactttcccg

SEQ ID NO: 308075 - DNA, 574 bp, Homo sapiens
  misc_feature: GZ8MTXP02FYXI1.22.65.F10.1.454.CMB.2.raw
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtatattaatgatcancagaaccaggaaacncccctaagctcctgatctatcgtaccttacttcctagtttcgacgtaaagggttcggggtacccctagtaaacggttcaagtggcaggtggatcgtgggcagtatttcactctacacctatccgcggtctcgactaaccgtagtaacgtacttacgtactaaacttactactacgtacaaactaacgtacttacacgtacccgaccccccgtataccgtaccgttccggaccgaacgggaccgaacgaccgtaggaacggtaaacgtaaacgaactcgtacgtctacgaacactactctctctactctttccc

SEQ ID NO: 308076 - DNA, 750 bp, Homo sapiens
  misc_feature: GZ8MTXP02GBKDY.22.65.F10.1.454.CMB.2.raw
  modified_base (96)..(96): a, c, t, g, unknown or other
  misc_feature (96)..(96): n is a, c, g, or t
  modified_base (134)..(134): a, c, t, g, unknown or other
  misc_feature (134)..(134): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
tcagacatacgcgtcacgaccggtgctcgatttagctacgctctaagggggagtcgagtctcagtcaggacacagcatggacatgagggtccccgntcagctcctggggctcctgctactctggctccgaggtnccagatgtgacatccagatgacccagtctccatcctcctgtctgcatctgtaggagacagagtcaccatccacctgccgggnaagtcagacgnaattaacgtacttaatttaaattggatcagcaagaaaccagggaaacncccctaagctcngatctangtactacttacgtagtttagactaaagggtcgggtaccccgtanaaacggggtttcaggttcggactaggtacggattccggtaggggaccaaggtacttttccaacctttcctacaaacccgtacgttcccgggcggttccttacgaacccgtaaaacccgttaggtaaacgtacgtttttaccggaacctttaaaaccgtttaaaccgttaaccttacggttaccaaaacctaacggttaaccgtttaaaccctacggtttacccccgccccccccggtaattaccccgtaccccgtttaaccgggaacccggtaaacggggtaccgaaccggtaaccggttacggggaaagtaaaccgtttaaaaccggaaacccgtttgggaccgggtccttacgggaaccctaacccgaacttaccggttaccgttacctttccgtaaccgttttcccccg

SEQ ID NO: 308077 - DNA, 532 bp, Homo sapiens
  misc_feature: GZ8MTXP02FIIU1.22.65.F10.1.454.CMB.2.raw
  modified_base (189)..(189): a, c, t, g, unknown or other
  misc_feature (189)..(189): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatccacctgccggcaagtcagagcaataacgtactaatttaatggtatcagacaagaaaccaggaaacgacccctaagctcctgatctatgctacttcctagtttgacaaaggtcgggtaccgtagaaggttcagtggcaggtgatcgtgggacagtatttcactctcacatccgcgtcngacactagtaancttcgactacttactactatacgaacacgtactacacgtccgacccccgatcctaccgtcgacgaacggactacgacgtacggagtaaactaaacgaactgtacgctacgaactacacttctctcttacctacttacccg

SEQ ID NO: 308078 - DNA, 603 bp, Homo sapiens
  misc_feature: GZ8MTXP02F7JEC.22.65.F10.1.454.CMB.2.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (263)..(263): a, c, t, g, unknown or other
  misc_feature (263)..(263): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctgccggnaagtcagngcataacgtactaattaatgtatcagcaagaaacaggaaacncccctaagctctgatctatgactacttcctagtttgacgtaaaggtcggggtaccctagtaaaggttcaggttcggactaggtggattcgagggactagtactttcactctacacctactccgcgtctcgacaactgtaagtacttacgactaacttactactacgtacaaactaacgtacttacgaccgttacccgaccccccgtataccctacccgttacggacccgaaacgggaccgaacgtaacgtagggaaacgtaaacgttaaaacgaacgttacgtacggacgtacgaaccgtaaccgtacgttaccttcgttaccttacctacgttaccccg

SEQ ID NO: 308079 - DNA, 601 bp, Homo sapiens
  misc_feature: GZ8MTXP02IJ97S.22.65.F10.1.454.CMB.2.raw
  modified_base (351)..(351): a, c, t, g, unknown or other
  misc_feature (351)..(351): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatcactgccggacaagtcagagacaataacgtacttaattaaattggtatcagacaagaaaccgaaggaaacacccctaagcctctgatctatcgtactacttctagtttgacgtaaggtcgggtccctagtaaaggttcaggtggacnggtagattcgtgggactagtatttccacttcctccactactccgtcgtctagacaacgtagaacgttacttacgactaaaccttatacgtagtaccaaacacgttaaccttacgtacgtacccgacccccgtatacccgtaccgttaccggaccgaacgggaaccgacggtaacgtacgggaagtaaacgttaaaacgacgtacggtacggactacgaacctactacttctacttcttacaactttcccg

SEQ ID NO: 308080 - DNA, 569 bp, Homo sapiens
  misc_feature: GZ8MTXP02GV9CS.22.65.F10.1.454.CMB.2.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccggganaagtcagagcataacgtactaatttaaattggtatcagcagaaaccagggaaacncccctaagctctgatctatcgctacttcctagtttgactaaaggtcggggtacctgaaggttcagtggcaggtggatcgtggggactagtatttcactctacacctactcccgcggtctcgacaacctagtaacgtactttcgactaacttactactgtacaaactagtacttacacgtcccgaccccctatacctaccgttacggaccgaaacggaccacggtacgtacggaacgtaacgtaaaacgaacgtcgtacggactcgaactacctacttctcgtcttactactttcccg

SEQ ID NO: 308081 - DNA, 563 bp, Homo sapiens
  misc_feature: GZ8MTXP02GHVPN.22.65.F10.1.454.CMB.2.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (369)..(369): a, c, t, g, unknown or other
  misc_feature (369)..(369): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatccacctgccgggnaagtcagagcaataacgtactattaaatggtatcagcagaaaccaggaacnccctaagctctgatctatcgactacttccagtttcgacgaaaggttcggggtacccgtataaaggttcaggtcgcaggtgatcgtgggcagtactttcactcncacctactccgcgtctcgacacgtagagtacttcgactaacttactactagtacaactagtaactacgtacgtacccgacccccgataccaccgtttacggaccgaacggacgacgtacgtaggaacgtaaacgtaaaccgacgtacggtacggcgtacgaaccactacgtacctacgtccttactacttcccg

SEQ ID NO: 308082 - DNA, 520 bp, Homo sapiens
  misc_feature: GZ8MTXP02HKW1V.22.65.F10.1.454.CMB.2.raw
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
  modified_base (314)..(314): a, c, t, g, unknown or other
  misc_feature (314)..(314): n is a, c, g, or t
tcagacatacgcgtcacgaccggtgctcgatttagctacgctctaagggggagtcagtctcagtcaggacacagcatggacatgagggtccccgctcagctcctggggctcctgctactctgactccgaggtgccagatgtgacatccagatgacccagtctccatcctccctgtctgcatctgtaggagacagatcaccatcacctgccgggnaagtcagagcataacgtactattaaatgtatcagcagaaaccaggaaacgcccctaagctcngatctatgctacttccagtttgacaaagtcgggtcctnaaggttcagtgcagtgatcgtgggcagtattcactctacacactccgcggtctgacaacctagaagtactttcgactaaacttactactagtacaacagtacttacacgtcgccccccgatcctaccttcggaccaacgggacacgacgtggaacgaacttaaaacgacgtagtacgctagaacacacgtctcgtcttcacttccc

SEQ ID NO: 308083 - DNA, 581 bp, Homo sapiens
  misc_feature: GZ8MTXP02HE5J0.22.65.F10.1.454.CMB.2.raw
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (356)..(356): a, c, t, g, unknown or other
  misc_feature (356)..(356): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatccacctggccgggacaagtcagagcataacgtactaatttaaatggtancagcagaaaccaggaacnccctaagctctgatctatgacttacttctagtttcgacgtaaaggttcgggtacccctagtaggttcaggtggacaggtgatcgngggactgtacttcacttcctacactacgtcccgtcgtctacgactaacctgtaacgtacttacgaaccttaaccttacgtactacgtacaaacgtattaccgtacgtacggtaccccacccccgtataccgtacccgtcggaccgaacgggacacgtacgtacgagtaaacgtaaacgacgtacgtacgctacgaacactacgtctacgtacttccactttcccg

SEQ ID NO: 308084 - DNA, 545 bp, Homo sapiens
  misc_feature: GZ8MTXP02IW1T7.22.65.F10.1.454.CMB.2.raw
  modified_base (190)..(190): a, c, t, g, unknown or other
  misc_feature (190)..(190): n is a, c, g, or t
  modified_base (274)..(274): a, c, t, g, unknown or other
  misc_feature (274)..(274): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatccactggccgggacaagtcagagacataacgtacttaatttaaattggatcagacaagaaaccaggaaacncccctaagcctcctgattctatgaccttacttcctagtttgactaaaggtccggggtcctanaaggttcagtgcagtggatcgngggactagtnttcactcncacatccgcgtctgcaacgtacgaagtcttacgactaacttactactataccaacacgtacttaccgagtacccgccccccgatcctaccgttacggaccgaaggacacgactaggaataacgtaaacacgtcgtacgctacgccaacntactnttcctcactttcccg

SEQ ID NO: 308085 - DNA, 625 bp, Homo sapiens
  misc_feature: GZ8MTXP02IL1OF.22.65.F10.1.454.CMB.2.raw
  modified_base (221)..(221): a, c, t, g, unknown or other
  misc_feature (221)..(221): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctggtaggagacagagtccaccatccacctggccggganaagtcagagcaataacgtattaattaattgatcagcaagaaaccaggaacnccccaagcctctgatntatgactacttcgagtttgacgtaaggtcgggtccctgaaggttcagtgctagtggatcgtaggactagtattccactcctacacctcgtccgtcgtcgtcgacaacgtagtaagttacttacgactaaccttacgtactacgtacaactaacgtaccgttacgaccgtaccccgaccccccgtattacccgtacccgttaccgggaccgtaaacggggaccgtacggtaacgtacggtaaacgtaaacgttaaaaccggtaacgttacggtaccggtacgttaccgaacgtaaaccctacgttaccgttacgttacctttacctacgtttcccccg

SEQ ID NO: 308086 - DNA, 566 bp, Homo sapiens
  misc_feature: GZ8MTXP02FJMJ8.22.65.F10.1.454.CMB.2.raw
  modified_base (274)..(274): a, c, t, g, unknown or other
  misc_feature (274)..(274): n is a, c, g, or t
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccggcaagtcagagcataacgtactatttaaatgatcagcagaaacaggaagcccctaagctccngatctatgctacttccagtttgacaaaggtcggggtcccgtanaacggttcagtggcagtggatcgngggcagatttcactctcacctatccgcgtctcgacaacctgaatatttacgactacttactactacgtacaaacagacttacacgtcgcccccccgatccctacccgttcggacccgaacgggacgaacgacgtacggaacgtaaacgttaaaaccgtaacgtaggttacggcgttacgaaccgaaccctaacgtccttggtttccttaccgtactttcccccgg

SEQ ID NO: 308087 - DNA, 682 bp, Homo sapiens
  misc_feature: GZ8MTXP02IT6NS.22.65.F10.1.454.CMB.2.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatcctccctgtctgcactgtaggagacagagtacaccactccacctacgccgggacgaagtacgagagacaactaacgttaacttaatttaaattaggtatactacgacgaacgaaacgaaacggaaacgacccctaacgtactcctagatacttatacgtactacctttactacgtttacgacgtaaacgggtacgggtcccgtacgtaacggtacgtagcggtgagtaggtagtacgtacggtanacgttnttacctactccgtacctacacgtcccgccggttcagacccgtaaacgtacgtaagtacgtttaccgactaacctttaactacgtacgtaaactaaccgaaactacgtttaaccaccgtacccggtacccccacgtctaccggttccggaacgaaccggacgacgaacgtacggtaaacgaaacttaaaaccggtaacgtacgggtcgacgacttccgaaaccctagttccgttacttccgttacctaccttaccgttacccccg

SEQ ID NO: 308088 - DNA, 801 bp, Homo sapiens
  misc_feature: GZ8MTXP02HLZG6.22.65.F10.1.454.CMB.2.raw
  modified_base (216)..(216): a, c, t, g, unknown or other
  misc_feature (216)..(216): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatccacctgcccgggnaagtcagagcaataacgtacttaatttaaatggtatcagacaagaaaccgaggaaacgcccctaagcctcctgactcgtatgactacttcaagtttgacgtaaaggtcggggtacccgtagtaaacggttcgacggttcggacgtaaggttcggtaacgttcggttacggggacctaaggttacttttaccaccgttccttaccgaaccccgtagttccccggtcggttccgtaccggtacctaaacccgttagaaacgtttaacgtttacccgtaaccttaaaacctttaccgtaaccttaggttaaacccgtaaaactaaccgttaaaccgtttaaccgaaccgttacccccggtaccccccccgtaactaccccggttaaccccgttacccgggaaacccggtaaaccggggaaccgaaacccggtaacggttaaaccggggtaaacggttaaaaaccgtttaaaacccggttaaaccggttaacggggtccgggttaaacccttcggaaaccccgtaaaccgtttaaccgttaaccggtttccgtttaacccgtttcctttaaacccggttttaccccccg

SEQ ID NO: 308089 - DNA, 710 bp, Homo sapiens
  misc_feature: GZ8MTXP02JSGOH.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagancataacgtactaatttaatggtatcagcaagaaacgaggaaacncccctaagctcctgatctatgactacttcctagtttcgactaaaggtcgggtacccgtcgtaaacgggtttcaaggttcggacgtaggtacggtagtcggttacggggactacggttactttaccgacttacctacccgaacctcgtcccggtcggttccttacgaccctaaccgtagtaaacgtactttaccggtactaaaccgtttaccttaacgttaccgttaacaaaccgtaacgttaccttaacgtaccgttaccccgaccccccgtaagttcccgtaaccccgttaccggaacccgtaaacgggaaccgaacccggtaaacggtacgggtaaacggtaaaccgttaaaaaccgggtacgtttacggacggggtaccttacggaacccgtaaccttaacgttccgttcggtttacctttaccggtaacgtttcccccg

SEQ ID NO: 308090 - DNA, 705 bp, Homo sapiens
  misc_feature: GZ8MTXP02J19F4.22.65.F10.1.454.CMB.2.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcacatccacctggccggnaagtcagngcataacgtattatttaaatggtatcagcaagaaaccgaggaaacncccctaagcctctgtatctatcgacttaccttcgtagtttagacgtaaagggttcggggtacccctagtaaacggttcaacgggttcggaccgtaggttaggggactcgggtaaggggtacctaggttaactttccacgttacttacccgaaccgtcgtcccggtcggtctacgtacctaaccgtagacgttaccttacgaacttaaaccgttactaacgtacgttaaccaacgtaacgtaccgttacgtaccggttaccccggacccccctagttaccccgtaacccgggtttacccggaaccggtaaaccggggaaccgtaaccggtacgggttacggaaacggtaaaccgttaaaaccggtacgttacgggtcggtaccgtacggaacctacccgtacttaccgttaccgttaccgttcctacctttccccg

SEQ ID NO: 308091 - DNA, 634 bp, Homo sapiens
  misc_feature: GZ8MTXP02IVNLG.22.65.F10.1.454.CMB.2.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccactccacctggcccgggacaagtcagagacaataaccgtatttaatttaatggtaancagacaagaaaccgaaggggaaaccncccctaagccctctagattactatcgtaccttacgttaccgtaggtttcgaacgtaaagggttccggggtaccctataaagggttccaggttcggacaggttgattccgaggggactagttacctttccaccgttccacgaccctacgtccccgggtgttacctacgactaaaccctaggtaaacttctttaccgacttaaaccgttactcgtacttaacaaccgtagttaccttaccgacgtacccccgacccccgtatcccctaccggtaccggacgtaacgggactacggaacgtaggattaaacggttaaacngtcgtcgnacncactntctntactctactccg

SEQ ID NO: 308092 - DNA, 598 bp, Homo sapiens
  misc_feature: GZ8MTXP02FQXVA.22.65.F10.1.454.CMB.2.raw
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacctggccgggacaagtcagagacataacgtactaatttaaatggtatcagcaagaaaccgagggaaacncccctaagctccgtagatctatgctacttccagtttgacgaaagggttcggggtcccgtagtaaaggtttcaggtcggacaggtcggagttcgtaggggacagtatttcaaccttctaccaccactcccgtcggtctcgacctaaccgtagtaacgtactttacgaactaacttactactagtacaaactacgtacttacacgtacccgccccccgtatcccgtaccgttcgaccgaacggacacgacgtaggaagtaactaaacgtacgtacgtacggtctacgaacctaccgtactccgttgttccttactacctttcccg

SEQ ID NO: 308093 - DNA, 584 bp, Homo sapiens
  misc_feature: GZ8MTXP02HVNWH.22.65.F10.1.454.CMB.2.raw
  modified_base (190)..(190): a, c, t, g, unknown or other
  misc_feature (190)..(190): n is a, c, g, or t
  modified_base (275)..(275): a, c, t, g, unknown or other
  misc_feature (275)..(275): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcaccatcacctggccggcaagtcagagcaataacgtactaatttaaattggtatcagacaagaaaccgaaggtaaacncccctaagcctccagactctatgtccttactttcctaagtttgacgtaaaggttcggggtccctagtaaggttcgaggtggacgaggtggtatcggtaggggactagtactttccactctaccacctacgtccgtcgtctcgacctaccgtgtaagtacttcgactaacttactactgtacaaactacgtacttacgcgtcccgacccccgatcctacccgtcggaaccgacggacacgtacgtggaacgtaaactaaacgaactcggtacgacctggcctacaacttcgtcgttacttctacttcccg

SEQ ID NO: 308094 - DNA, 587 bp, Homo sapiens
  misc_feature: GZ8MTXP02IED6K.22.65.F10.1.454.CMB.2.raw
  modified_base (163)..(163): a, c, t, g, unknown or other
  misc_feature (163)..(163): n is a, c, g, or t
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
  modified_base (551)..(551): a, c, t, g, unknown or other
  misc_feature (551)..(551): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcnccatcctcctgtcngcatctggtaganacagagtcaccatcacgtggccggnaagtcagagacaataacgtatatttaatgtatcagacaagaaacgaaggaaccgacccctaagcctctagatctatcgtactacctttaccgtagtttcgaacgttaagggttcggggtaccccgtacgtaaacggttcgacggtggtacgaggtgggtactcggagggtacctagtatttcctactcctcaacctcgtccgtcgtctacgactaacgtagtaagttacttcgactaaccttactactntacanactactactacgtcccnccccgtatccgtccgtaccgacgacggacacgacgtagagtaaacttaaacgaacgtcgacggcngaacctactactcttattccttactactttaccccg

SEQ ID NO: 308095 - DNA, 689 bp, Homo sapiens
  misc_feature: GZ8MTXP02FNV53.22.65.F10.1.454.CMB.2.raw
  modified_base (190)..(190): a, c, t, g, unknown or other
  misc_feature (190)..(190): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccgggcaagtcagagacaattaacgtacttaatttaaatggtatcagacaagaaacccagggaaaccncccctaagcctcctagatctagtcgtaccttaccttccgtaggtttcgaacgtaaaggggttccggggtaccccgtaagtaaacgggtttcaagggtcggactaggtcggtactcggtaggggactagtactttccaccttcaccgacctacgtcccgtacgtcctacgacctaaaccgtagtaaactactttacgaccttaaccttactacttacgtaacctaaacacgttaaccttaccgaccggtaccccgaccccccgtattccccgtaacccgttaccgggaaccgaaaccgggaccgaaccgtaacgtacggaacgtaaaacgttaaaccggtaacgtcggtacggtaccgtacggaacctaccgtaacgttccttacgttaccctttacctaccgtttcccccg

SEQ ID NO: 308096 - DNA, 782 bp, Homo sapiens
  misc_feature: GZ8MTXP02HZVQN.22.65.F10.1.454.CMB.2.raw
  modified_base (188)..(188): a, c, t, g, unknown or other
  misc_feature (188)..(188): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctcatcctcctgtctgcatctgtagganacagatcaccatccactgccggcaagtcagacgcaattaacgtacttaatttaaattggtatcaagacaagaaaccgagggaaacgcccctaagcctacctagacttctatcgtaccttaccttaccgtagttttcgaacgtaaagggtccggggttacccctacgaaacgggtttcaaggttcggacgtaaggttcgggaattccggtaggggtacctaagggttaacttttccgaaaccttccgttacgaaacccgtagttcccggtcggtccttacgacccgtaaaccgttaacggtaaacgttaacctttttaccggaaccttaaaccgtttaaaccgttaaccgttacggttaaacccctaaaacgttaaccggttaaccctttaaaccggtaacccgggttacccccgtaaccccccccggttactaccccggttaaccccgtttacccgggaacccggtaaaacggggacccgtaaaccggtaaaccggtacgggaaacgttaaaacgttaaaaaccggaaacgttcggtacggtactacgaacccgtaactacttacgttcgttacctttacctaacgtttccccg

SEQ ID NO: 308097 - DNA, 625 bp, Homo sapiens
  misc_feature: GZ8MTXP02GEYG7.22.65.F10.1.454.CMB.2.raw
  modified_base (218)..(218): a, c, t, g, unknown or other
  misc_feature (218)..(218): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaagggggagtcagtctcagtcaggacaaagcatggacatgagggtccccgctcagctcctggggctcctgctactctggctccgaggtgccagatgtgacatccagatgacccagtctccatccctcctgtctgcatctgtaggagacagatccaccatccacctggccggganaagtcagagcaagttaacgtacttaatttaaagttggtatcagacaagaaaccgagggaaacncccctaagcctcctgatctatgcttacttctagttacgacgtaaacggtcggggtaccctagtaaggtcaggtcgactaggtgtatcgtagggactagtcttcacttctaccactacgtccgtcgtctacgactaaccgtagtaacgtacgttacgactaacttactactacgtacaactaagtacttacgacgtcccgacccccgtactacctaccgttcggaaccgtaacgggaaccacgtaacgtacgggtaactaaacgtaaacgtacgttacggacggtacctacgaccgtaaccgtacttccggttacgttaccttactaacctttacccgttccccg

SEQ ID NO: 308098 - DNA, 533 bp, Homo sapiens
  misc_feature: GZ8MTXP02IY7AX.22.65.F10.1.454.CMB.2.raw
  modified_base (190)..(190): a, c, t, g, unknown or other
  misc_feature (190)..(190): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacctgccggcaagtcagagcaataacgtactatttaaattggatcagcagaaaccaggaacncccctaagctcngatctatgctactcagtttgactaaggtcgggtccctagaaggttcagtgcagtgatcgagggcagtatttccattcacnccatccgcgtcngcaacctagaatacttcgactaacttactactagtacaacacgtaactacgtacgtaccgacccccgatacctaccgtaccgaccgaacggtacacgaacgtaggagtaaacgttaaacgaactcgtacgtctagaacctacgactctagtcttactacttccc

SEQ ID NO: 308099 - DNA, 591 bp, Homo sapiens
  misc_feature: GZ8MTXP02IZ8EX.22.65.F10.1.454.CMB.2.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (362)..(362): a, c, t, g, unknown or other
  misc_feature (362)..(362): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtcctgcatctgtaggagacagagtcaccatcacctgccggganaagtcagngcaataacgtataattaatgtatcagacaagaaaccaggaaacnccctaagctctagatctatcgtactacttcagtttagacgtaaggtcggggtaccctagtaaaggttcaggtggctaggtgattcggcggganagttatttcacgtcctacaccactccgcgtctacgacaaccgtagaacgtacttacgactaacttactactatactaaacatacctacaccgtacccgacccccgtatacccgtaccgttaccggacccgtaaacgggaccgaacggtaaccgtaggtaaacgtaacgtaaaactacgtagtacggtctacggaactaccacgttactcgttaccttctactttccccg

SEQ ID NO: 308100 - DNA, 577 bp, Homo sapiens
  misc_feature: GZ8MTXP02G8GX6.22.65.F10.1.454.CMB.2.raw
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacctgccggcaagtcagagcaataacgtattaattaatggtatcagcaagaaaccgaggaaacncccctaagcctcctagactctatcgtactacttcctagtttgacgtaaggtcggggtacctagaaggttcagtggacaggtgatcgagggacagtattcactctacacactccgcgtctcgacacgtagtactacttacgactaacttactactacgtacaactacgtacttacgacgtacccgacccccgtataccgtaccgtacggaccgtaacgggacacggtaaccgtaggaaacgtaacgttaaacgacgttacgtacggtactacgaacctacctacgtcttacgtaccttacctactttcccg

SEQ ID NO: 308101 - DNA, 682 bp, Homo sapiens
  misc_feature: GZ8MTXP02FN4AC.22.65.F10.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatccctccctgtctgcatctgtagganacagatcaccatcacctggccgganaagtcagagcaataacgtacttaatttaaatggtatcagcaagaaaccaggaaacncccctaagctcngatctatcgcttacttccgtagttacgacgtaacgggttccgggtaccctagtaacggttcaggtgacgtaggtggactcggagggactagttactttcacttcctacacctacgtccgtcgtctacgaccgtaacgtagaaacgttcttacgaaccttaaccttactacgttacgtaacctaaacgtaacgtaaccttaaccgtaccgggtacccccgtaccccccccgtattaccccgttaccccggttacccggaaccggaaaccggggtaaccgaaccggtaaccggtaagggtaaacgtaaaaccgtttaaaaccggtacggttacgggtacggtccgtaccgaaccctaaccgttaacgttcgttacgtttccttaccgtacctttcccccg

SEQ ID NO: 308102 - DNA, 646 bp, Homo sapiens
  misc_feature: GZ8MTXP02IYX4F.22.65.F10.1.454.CMB.2.raw
  modified_base (221)..(221): a, c, t, g, unknown or other
  misc_feature (221)..(221): n is a, c, g, or t
  modified_base (280)..(280): a, c, t, g, unknown or other
  misc_feature (280)..(280): n is a, c, g, or t
  modified_base (379)..(379): a, c, t, g, unknown or other
  misc_feature (379)..(379): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgatccagtctccatccctccctgtctgcatctgtaggagacagagtcaccatccaccgtggccggganaagtcagagacaataacgtacttaatttaaatggtatcagacaagaaacgaaggaaacncccctaagctcctagatactatgtacttacttcctagtttgacgtaaagggttcggggtcccgtagtaggtttccgagtggacgaggtggtacttcggnggggactaaggtactttaccaccttcaccaccgtacgtcccggtccggttctacgtaccctaaaccgtagtaacggttaactttaccggaaccttaactttaccgtacttacgttaaccaaacgtacgtaaccttacgaccgtcccccgtacccccgtataccgtacccggttccggaaccgaaacgggtaccaacggtacgtacggtaaactaacgttaaaacgcgttacgccggtcaacgtacactacgtactctacctctaccg

SEQ ID NO: 308103 - DNA, 611 bp, Homo sapiens
  misc_feature: GZ8MTXP02HMWPA.22.65.F10.1.454.CMB.2.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctggccgggnaagtcagagcataacgtatattaaatgatnancaagaaacaggaaacncccctaagctcngatctatgactacttccagtttgacgaaaggtcgggtccctagaaggttcaggtgctagtggatcgtagggactagtatttacacttctacactactccgacggtctacgacaaacctagtaagtactttcgaactaaacttactactagttacaaactacgtaactacgacgtacccgcccccgtataccaaccgttccggaccgaaacggggaaccaaccggtaacgtacgggtaaacgtaaacgtttaaaaccggaacgttacggtacggtacgtacggaaccgtaaccctaacgttccgttacgtttacccttacgttaactttacccccg

SEQ ID NO: 308104 - DNA, 595 bp, Homo sapiens
  misc_feature: GZ8MTXP02H5T49.22.65.F10.1.454.CMB.2.raw
  modified_base (162)..(162): a, c, t, g, unknown or other
  misc_feature (162)..(162): n is a, c, g, or t
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (559)..(559): a, c, t, g, unknown or other
  misc_feature (559)..(559): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcnccactcctcctgtctgcatctggtagganacagagtccacatcacgtggccgganaagtcagncaataacgttataatttaagttgatacgagacaacgaaacgaaggaaaccnccctaagctctagattctatcgtactactttcgagtttagacgtaagggtccgggtacctagaaggtnacgtgactagtggatcgttagctatatttccgactctacagccctccgngtcncactaccgtagtaacgttacttactaaccttaacctttactacgttacgtaactaactacgtaacttaccgtaccggtccctacccccgatccctaccgtacggaaccgacgacgtaacgacggtataaacggtaacttaaaagtccgttagacgtcgtacnccgtactaactcgtacttccttagtacctttccccg

SEQ ID NO: 308105 - DNA, 637 bp, Homo sapiens
  misc_feature: GZ8MTXP02F4UWE.22.65.F10.1.454.CMB.2.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcaccgtgccgganaagtcagagcaataacgtactaattaatggtatcagcagaaaccaggaaacncccctaagctcctgatctatgtctacttccagtttgactaaaggtcggggtacccgtagtaaacggttcaagggttcggaccgtaggtacggtaatccggtaggggtacctagggtacttttaccaaccgttcctcaaccctagtcccgtccggttctcgacctaaaccgtgtaaaggtactttacggaacctaactttacgtaactcgtaacaactacggtaacttacaacgttccgaccccccgtatcccgtaccgtccggaccgaaacgggtacaacggtacgacggtaagtaaacgttaaaacgtaacgtcggtacggtacgtacgaacccgtactaacgtcctcgtacttccgtactttaccccg

SEQ ID NO: 308106 - DNA, 575 bp, Homo sapiens
  misc_feature: GZ8MTXP02FSQDO.22.65.F10.1.454.CMB.2.raw
  modified_base (190)..(190): a, c, t, g, unknown or other
  misc_feature (190)..(190): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggcaagtcagagcataacgtactattaatgatcagcagaacaggaaacnccctaagctcngatctatgctacttcagtttgactaaaggttcggggtccctagaaggttcaggtggcaggtggatcgtagggacagtatttcgactctacaccatccgcggtctgtaacctagtaagtattcgactaacttactactagtacaaactagtaacttacgacgttacccgacccccgataccctaccgttacggaaccgaacgggaccacggaacgtacgggaacgtaaacttaaaacgaaacgttcggtacggtcctacggaccaacgtactaccttcgttcctttacctacttcctttaccccg

SEQ ID NO: 308107 - DNA, 611 bp, Homo sapiens
  misc_feature: GZ8MTXP02FF5AS.22.65.F10.1.454.CMB.2.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggnaagtcagagcaataacgtacttaatttaatggtatcagcaagaaaccgaggaaacncccctaagctcctagatctatgtccttacttcctaggtttcgacgtaaacgggttcggggtaccctagtaaacggtttcaaggtcgggcaaggtggtaacgtcgtaggggactagtacttttcgacttctacacctatcccgtacgtctcgacaacttagaagtactttcgaactaccttactactagtaccaaactacgtaacgttaccacggtcccgtaccccccgattcccgtaacccgttccggaaccgaacggggacaaccggtacgtaggaagtaaacgtaaacgtacgtacgtcggtactacgccgactacgtctcgttactctactttcccg

SEQ ID NO: 308108 - DNA, 528 bp, Homo sapiens
  misc_feature: GZ8MTXP02GZQMA.22.65.F10.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
  modified_base (321)..(321): a, c, t, g, unknown or other
  misc_feature (321)..(321): n is a, c, g, or t
  modified_base (434)..(434): a, c, t, g, unknown or other
  misc_feature (434)..(434): n is a, c, g, or t
  modified_base (476)..(476): a, c, t, g, unknown or other
  misc_feature (476)..(476): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacctgccggnaagtcagagcataacgtactattaaatggtatcagcagaaaccaggaaacncccctaagctcctgatctatgctacttccagtttgactaaaggtcggggtcccgtnaaaggttcacgtggcagtggatcgtgggcagtatttcactctcacactccgcgtctgcaacctgaagtactttcgactaacttactaactgtacaacagtactacacgtaccncccccgatccaccttcggaccgaagggacacgactagggaanaacgtaaacgaactgtacggctgaaccactactcgtatccttacacttcccg

SEQ ID NO: 308109 - DNA, 675 bp, Homo sapiens
  misc_feature: GZ8MTXP02HE1TU.22.65.F10.1.454.CMB.2.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacctggccgganaagtcagagcaataacgtacttaattaatggtatcagcaagaaaccaggaacnccctagctctagatctangtactacttacgtagtttcgacgtaaaggtcgggtacccgtagtaaaggttcgacggtggccgtaggtggtactcgggtagggactaacgttatttacccacttcctaaccgacccgtaccgtcccgtccggttacctacgacctaacccgtagaagttaccttacgaacttaacctttactaccttagtaccaaacgtacgtaccgttacaaccggtccccgacccccgtaagtaccccgtacccgttaccggaaccgaaccgggtaccgaaccggtacggtaaacgggtaacgtaaaacgttaaaaccggtaccgttacggtacggtacctacggaaccctaaaccggtacttacggttacgttaccttacctaacggtttcccccg

SEQ ID NO: 308110 - DNA, 570 bp, Homo sapiens
  misc_feature: GZ8MTXP02G17TO.22.65.F10.1.454.CMB.2.raw
  modified_base (269)..(269): a, c, t, g, unknown or other
  misc_feature (269)..(269): n is a, c, g, or t
  modified_base (289)..(290): a, c, t, g, unknown or other
  misc_feature (289)..(290): n is a, c, g, or t
  modified_base (374)..(374): a, c, t, g, unknown or other
  misc_feature (374)..(374): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcactggccggcaagtcagagcaataacgtactaattaaattggtatcagcaagaaacaggaaacncccctaagctctagatctannccttacttccgtagtttacgacgtaaaggtcggggtacctagaaaggttcaggtgcagtggatcgtgggactagtatttcactntacaccgtatccgcgtctgacaactagtaaacgtattcgtaacctaaacttacgtaacttacgtactaaactacgtaacttaaccacgtacccgtaccccccgaataccctaccgtaccggaccgaaacggacgtaacgacgtaggagaaacgtaaaaccgtaagcgtacgctagcacatactctctttacactcc

SEQ ID NO: 308111 - DNA, 756 bp, Homo sapiens
  misc_feature: GZ8MTXP02GARRN.22.65.F10.1.454.CMB.2.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
tcagacatacgcgtcacgaccggtgctcgatttagctacgctctaagggggagtcagtctcagtcaggacacagcatggacagtgagggtccccgctcagctcctggggctcctgctactctggctccgaggtgccagatgtgacatccagatgacccagtctccatcctcctgtctgcatctgtagganacagagtcaccatcacctgccggcaagtcagagctataacgtactattaatggtatcgagcagaaaccaggaaacncccctaagctcctgatctatgacttacttccagtttgacgtaaaaggttcggggtaccccgtagtaaacgggtttcgaacgggttgggcctaagggttcggtaacgttacccggttaggggaaccgtagggtaaactttttaccgaaacccgttcctttaaccgaaaccccgtaacgttcccgggtaccggttacccgttacggttaaaaccccgttaggtaaaacgttaacgtttaccgtaaccggttaaaaccctttacggttaaccttacggttaaccctaaaccgtaacgggttaaacctttaacgtacccggtttacccggaacccccccgttagtaccccgtaccgtttacccggaacccgtaaacggggtaaccaaaccggtacgttaacgggaacgtaaacgtttaaaaccgaaaccgttggtaacggtcgtacggacctaaccgtaacttccgtacgttccttactaacttccgttccccg

SEQ ID NO: 308112 - DNA, 659 bp, Homo sapiens
  misc_feature: GZ8MTXP02G4ZLM.22.65.F10.1.454.CMB.2.raw
  modified_base (190)..(190): a, c, t, g, unknown or other
  misc_feature (190)..(190): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatccaccgtggccggacaagtcagagacaataacgtattaatttaaagttggtatacagacaacgaaaccgaggaaaccacccctaagcctacctagattctatcgtacttacttcgtagtttacgacgtaaacgggtcgggtaccctaggtaaaggttcgaggtggactaggtggtacttcggaggggactagttactttccaccttcctaccaacctaccgtcccggtaccgttcgtacgaaccgtaacctagtaaacgttacttaccgtaaccttaaacgtttactacttacgtaaccaaacgtacgttaacctaccgacggtaccccgacccccgtatcccgtacccgtacggaccgaaagggaccaacgtacgtaggaaacgtaaacgtaaacggtacgtcggtacgtctacgaacctactacgttcgtacgttaccttactcgtttacccccg

SEQ ID NO: 308113 - DNA, 588 bp, Homo sapiens
  misc_feature: GZ8MTXP02GWPUX.22.65.F10.1.454.CMB.2.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtccacatcactgccggnaagtcagngnataactactaatttaagtgatcagcaagaaaccaggaacncccaagctcnatctatgactacttcagtttgacgtaaggtcgggtacctagaaggttcaaggtcggactaggtggtatcgtagggactagtacttcgacctcgtacaactcgtcgtcgtactcgactacgtagtaacgtacgttacgactaacttactacgtacgtaacgtaacacgtaaccttacaccgttaccgaccccctagtaccctaccgttaccggaaccgtaaaggtaccgaacgtacgtaacggtaagtaaacgttaaacgaacgttggtaacgtcgtacgaacctaacgtctacgttcgtacttactacgtttcccg

SEQ ID NO: 308114 - DNA, 684 bp, Homo sapiens
  misc_feature: GZ8MTXP02HBST7.22.65.F10.1.454.CMB.2.raw
  modified_base (218)..(218): a, c, t, g, unknown or other
  misc_feature (218)..(218): n is a, c, g, or t
tcagacatacgcgtcacgaccggtgctcgatttagctacgctctaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctggccggganaagtcagagcataacgtactaatttaattggtatcagacaacgaaaaccgagggaaacacccctaagcctctagattctatcgcttactttccgtagtttcgaacgtaaacgggttcgggggtacccctaggtaaaacggggtttcacgggttagggcgtaaggtacgggattccggttggggaactaggtacttttacaaccttcaccacctaacgtcccggtcggtccttacgaccgtaaacccgtagtaaacgttactttaccgtactaaacttacctacttagtacctaaacaacgtaacttaaccgtacgtacccgtccccccgatcccgtaacccgttaccggaacccgaaacggggaacaaccggtaacgtacgggaaagtaaacgttaaaacggaaacgttggtacggtaccttacgaactacccgtacgttctacgttaccttacctacgtttcccg

SEQ ID NO: 308115 - DNA, 708 bp, Homo sapiens
  misc_feature: GZ8MTXP02ISBM0.22.65.F10.1.454.CMB.2.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatccaccgtggccgganaagtcagacgactaataacgtacttaatttaagtgtatcagacaagaaacccgaggaaccnccctaagcctctagatactatcgtactacttcgtagttacgacgtaaggtccgggtacccgtagtaacgttcgaaggtgacgagggttacggacgttcggagggtacgtagtacttttacccacttacctccgtaaccgtacgttcccggtcggttacctacggacctaaccgtaagtaacgttaccttacgtaaccttaaacttacttaacgtacggtaccaaacgtaccgttaacttaccgtacggttaccccgacccccgttacgtaccgttacccgtacccggtttaccggaaccggtaaacgggacccgtaacggtaacgtacgggtaaaacttaaacggttaaaaccgtacggttacggtacccgtacgtccggtaaacctaccggttaaccgtccgtttaccgttacttaacccgtttccccg

SEQ ID NO: 308116 - DNA, 535 bp, Homo sapiens
  misc_feature: GZ8MTXP02G4E2Z.22.65.F10.1.454.CMB.2.raw
  modified_base (194)..(194): a, c, t, g, unknown or other
  misc_feature (194)..(194): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacanagtcacatcacctgccggacaagtcagagcataacgtactaattaaattggtatcagacaagaaaccaggaaacgccctaagctcctgatctatgctaacttcctagtttgcgaaaagtcggggtaccctacgaaaggttcaggtgacagtggagtcgtgggacagtatttcactctcaccatccgcgtctgacaactggaanatttcgactaacttactaacttnctaaanacgtacttacagtcccgacccccgatccaacttcggaccaacgggacaccggtaacaggaataaactaaacgaactacgcgacgacgcacactactctactactactcc

SEQ ID NO: 308117 - DNA, 679 bp, Homo sapiens
  misc_feature: GZ8MTXP02GFWD5.22.65.F10.1.454.CMB.2.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgganaagtcagagcaataacgtactaatttaaatggtatnagacaagaaaccgaggaaacgcccctaagcctctgatctatgtaccttacttccgtagtttcgacgtaaagggtcggggtaccctagtaaacggttcaggtcggactaggtggaatcggtaggggactagtactttccaccttccgtacaccgtacgtccgtcgtacgtcgaacctaacgttagtaaagtacgtttacaacctaaacttactacgttagttaaccaaacgtaacgtaccgttaacgtaccggttaccccaccccccgtactacccgttacccggttaccggaaccgaacgggaaccgtaaccggtaacgtaacgggaaacgtaaacgttaaaaccggtaacgttcgggtacggtcctaccggaaccctaacccgtactttaccggttacgtttaccctttaccgtaacctttcccccg

SEQ ID NO: 308118 - DNA, 590 bp, Homo sapiens
  misc_feature: GZ8MTXP02IOQP8.22.65.F10.1.454.CMB.2.raw
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctcctgtctgcatcgtgtaggagacagagtcaccatcacctggccggacaagtcagacgcaattaacgttacttaatttaaagttggtatcagacaagaaaaccgaagggaaacacccctaagcctctagactctatcgaccttacttcctagtttgacgtaaaggtcggggtacctagtaaaggtcaggtaggctaggtggagtcggtagggactagttattaccacttcgtaccactacgtcccgtcggtctcgacctaaacgtgtaaacttcgtttacactaaacttactactagtacaaactagtacctacacgtccccacccccgtatacctaccgtcggaccgaaacggcaacgacgtagtaagtaaactaaacgactcggacgctagccgtatactctgttcctacttactccccg

SEQ ID NO: 308119 - DNA, 777 bp, Homo sapiens
  misc_feature: GZ8MTXP02JHNGQ.22.65.F10.1.454.CMB.2.raw
  modified_base (194)..(194): a, c, t, g, unknown or other
  misc_feature (194)..(194): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtcctccactccctcctgtctgcatctggtagganacgagacgtccaaccactccgaccgtggcccggggacaaagtcgaagagactaattaaaccgtacttaaagtttaaagtggtatacgaagaccaaacggaaaaccgaacgggaaacctacccccgtaagtccctaccgtagacttcctagtctaccttaccgtttacgtaggtttacgaacgttaaacggggttccggggttacccgtagtaacggttccgaggtcggacgtagtacgggattcgggtacgggactagtatttccaccttcgaccacctcgtcccggtacggttcctacggacctaaaccggttagtaaacgtttccgttaccgtaacctttaaacctttaccttaaaccgtacgtaaacctaaacgtaaccttaacgttaccgtacccggtaacccccgtaccccccggtattaccccgttacccggttacccggaaaccgggtaaacggaaaccctaccggtaaccggtaaaggttaaaccgttaaaacggtaaaccgtaacggttcggtaaccggcttaacggaacccctacgtaacgttccgttgtaccctttcgtacccctttacccg

SEQ ID NO: 308120 - DNA, 585 bp, Homo sapiens
  misc_feature: GZ8MTXP02GOYAK.22.65.F10.1.454.CMB.2.raw
  modified_base (270)..(270): a, c, t, g, unknown or other
  misc_feature (270)..(270): n is a, c, g, or t
  modified_base (399)..(399): a, c, t, g, unknown or other
  misc_feature (399)..(399): n is a, c, g, or t
  modified_base (582)..(582): a, c, t, g, unknown or other
  misc_feature (582)..(582): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagatcacatcactgccaggcaagtcagagcataacgtattaatttaatggtatcagacaagaaaccgagggaaaccncccctaagcctactgatctatcgtacttacttccgtagtttcgacgtaaacgggtcgggtaccctagtaagttccagtgcaggtgatcggtgggacagttacttcgactcgtacaccacgtccgtgtcncgacaaccgtagaacgtcttacgactaacttacgtactgtaacacgtaagtaccttacgaccgtacccccgaccccgtatacccgtaccgttccggaaccgaacggacctacggtacgtaggtaaacgtaacgttaaacgacgtggtaacgtcaacgtactaactctccgttcgtctttaccnccg

SEQ ID NO: 308121 - DNA, 664 bp, Homo sapiens
  misc_feature: GZ8MTXP02ICTEO.22.65.F10.1.454.CMB.2.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaganacagatcacntcactgcgganagtcagancataactactattaatgtatcancagaaacaggaacncccctaagctctagatctatcgtctacttcgagtttcgataaaggtcgggtaccctgtaaggttcacggtgacgtagtggtatcgtagggactagttacttaccgcttctaccacctacgtccgtcgttcgtacgtctaaccgtagtaacgtacgtttaccgacgttaaaccgttacgttaccgttacgtactaaaccgtaacgttaaccgttaaccgtaccggtacccgtaccccccgtagttacccgttacccggtttacccggaaccgtaaccgggtaacctaaccggtaaacggtacggtaaacggtaaacgtttaaaaccggaacgtttacggtaccgttacgtaccgtaaccgtaaccgtacgtttaccgtacgtttaccgttaccgttaaccgtttccccgg

SEQ ID NO: 308122 - DNA, 765 bp, Homo sapiens
  misc_feature: GZ8MTXP02JPWQX.22.65.F10.1.454.CMB.2.raw
  modified_base (297)..(297): a, c, t, g, unknown or other
  misc_feature (297)..(297): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatcgacccagtctccactccctccctgtctgcatctggtaggagacagagtccaccatccaccgtgccgtgacaagtcaggagctaagttaacgtaacttaatttaaagttggtaatcgaagacaacggaaaccgaaggggaaaccncccctaaaggtccttaccgtgaacttcgtatacgtctacttccgtaagtttcgaacggttaaaggtccgggggttcccctagtaaacggttccaaggggtcggtactaacgggtggtaacgttccgtacgggggaacttaacggtacttttaccaccgttacgtcccccaaaccgtacggtccccggtaccggttaccgtacggacccttaaacccgtaacggttaacgttaaacgttacccggtaacccgttaaaccgtttaaccttaaccgttacggttaaacccaacgttaacgttaaacccgtttaaccgaccggttacccccgacccccgttaaccgttacccgttaacccggttacggaacccgtaaacgggaaccgaaccggtacggtaacggtaacgtaaactaaacggtaacgttcggtacgacgtaacgaccaccgtacgtctccgtacttactcccg

SEQ ID NO: 308123 - DNA, 617 bp, Homo sapiens
  misc_feature: GZ8MTXP02IGOOT.22.65.F10.1.454.CMB.2.raw
  modified_base (188)..(188): a, c, t, g, unknown or other
  misc_feature (188)..(188): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (390)..(390): a, c, t, g, unknown or other
  misc_feature (390)..(390): n is a, c, g, or t
tcagacatacgcgtcacgaccggtgctcgatttagctacgctctaaggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcactggccgganaagtcagancaataacgtattaatttaaattgtatcagcaagaaccgagggaaacnccctaagctcctgactactatcgccttacttcctaaggtttcaacgtaaaggtcggggtccccagtaaggttcaaggtgactaggcgagttcgtagggcagttattcacgtctcacgtacncgtcgctcgacctactagaatactttacgactaacttaacgtctagttacaactagtaccttacacgtaccccgtcccccgtataccgtacccgttacggaaccgaaacgggaccgaacgtaccggtagaaacggtaaactttaaaaccgaaccgtttggaaacggttcctaggtaacccgaaccgtaacttccgttaacggtttcccttacgtaaccgtttccccg

SEQ ID NO: 308124 - DNA, 645 bp, Homo sapiens
  misc_feature: GZ8MTXP02GS1W3.22.65.F10.1.454.CMB.2.raw
  modified_base (95)..(95): a, c, t, g, unknown or other
  misc_feature (95)..(95): n is a, c, g, or t
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
tcagacatacgcgtcacgaccggtgctcgatttagctacgctctaagggggagtcagtctcagtcaggacacagcatggacatgagggtccccgntcagctcctggggctcctgctactctggctccgaggtgccagatgtgacatccagatgacccagtctccatcctccctgtctgcatctgtagganacagagtcaccatcacctgccggnaagtcagncataacgtactattaatgatcancagaaacaggaaacncccctaagctctgatctangtctacttctagtttcgacgtaaaggtcgggtacctactaaggtcaaggtggactaggtaggaacttcggtaggggactaggtacttttaccaccttaccgtactaaccctaagttcccgtcggttaccgttacgacctaaacccgttagtaaacgtactttaccgaaccttaaacttaacctacttacgtaaacctaaactaacgtaacttaacgtaccgtacccgacccccgtatacccgtaccgttaccggaccgtaaacgggaccaacggtaacgtacgggaaacgtaaacgttaaaccggaaacgttcgtaacggcttaacggcctacctacgttacgtcttacctttacgtacttccccg

SEQ ID NO: 308125 - DNA, 664 bp, Homo sapiens
  misc_feature: GZ8MTXP02FPEOJ.22.65.F10.1.454.CMB.2.raw
  modified_base (656)..(656): a, c, t, g, unknown or other
  misc_feature (656)..(656): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatccactgccgggacaagtcagagcaattaacgtacttaatttaaattggtatcagacgaacgaaaccgagggaaacgccccgtaagcctcctgtactcgttatcgtacttaccttcgtagttttacggacgtaaacgggttccggggtaccccgtgtaaacgggttcaaggtggacgtaggtggtaactccggttacggggactacggttactttaccacgttcctactaaacccgtacgtcccggtcggttaccctcgtaccgtaaacgtagtaacgttacgttacgtaaccttacttaacttacttagaaccaacgtacgtacttactaccggtcccgacccccgtagtccctacgttaccgaccggtaacggacgtacggacgtacggaagtaacgtaaaacgtacgtagtacggtcgtacgaacgtactacttcggttctactttaccnctttcccg

SEQ ID NO: 308126 - DNA, 626 bp, Homo sapiens
  misc_feature: GZ8MTXP02JLIKE.22.65.F10.1.454.CMB.2.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (414)..(414): a, c, t, g, unknown or other
  misc_feature (414)..(414): n is a, c, g, or t
  modified_base (572)..(572): a, c, t, g, unknown or other
  misc_feature (572)..(572): n is a, c, g, or t
tcagacatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtcctccatcctccctgtctgcatctggtaggagacagagtcaaccatcaccgtggcccggganaagtcagagacaattaacgtacttaatttaagtggtatcagacaaggaaaccgaggaaaccnccccgtaagcctactagattactagtcgtaccttacgttccgtagtttacgacgtaacgggtccgggtaccctagtaaggttcaggtcgagtaggtgcttcggacgggctagttacttcacctcacaccncgtcccggctctacgacctaacgtgaaacgtcttaccgaaccttaacttacacgttacgactaaagtacgttaaccttaccgaccgtcccccaacccccgtataccccgtaccgttaccggacgaacggtaccagtacgtaggactaaacgtaaccgngtacggtcgactacgaacctaacgtcttcgtattaccctcgtaccgtttccccg

SEQ ID NO: 308127 - DNA, 607 bp, Homo sapiens
  misc_feature: GZ8MTXP02IVHSU.22.65.F10.1.454.CMB.2.raw
  modified_base (95)..(95): a, c, t, g, unknown or other
  misc_feature (95)..(95): n is a, c, g, or t
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (479)..(479): a, c, t, g, unknown or other
  misc_feature (479)..(479): n is a, c, g, or t
tcagacatacgcgtcacgaccggtgctcgatttagctacgctctaagggggagtcagtctcagtcaggacacagcatggacatgagggtccccgntcagctcctggggctcctgctactctggctccgaggtgccagatgtgacatccagatgacccagtctccatcctcctgtctgcatctgtaggagacagagtcacatcactgccggnaagtcagagcataacgtactattaaatgatcagnagaaaccaggaaancccctaagcctctgatctangtctattccagtttgacaaacggttcggggtacccgtanaaaggtttcaagtgacgtagtaggatcgtaggganacggtatttacgactctacaaccacgtcccgtcggttctacggacctaaacccgtagtaaagtacgtttacgactaaaccttaactactagttaccaaaccgtaagtaacctttacacggtacccnccccccgtaaatcctaacccgttcgacccgaaagggtaccaacgaccgtaggaaagtaacttaaaaaccggaatcgttacggacttacggaacgttaaccgaatcctcggttctaacctatttccccg

SEQ ID NO: 308128 - DNA, 512 bp, Homo sapiens
  misc_feature: GZ8MTXP01BHJGE.9.12.B01.1.454.CMB.2.raw
  modified_base (419)..(419): a, c, t, g, unknown or other
  misc_feature (419)..(419): n is a, c, g, or t
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgtttatacggctccgacaacaagaactacttagcttggtatcagcagaaaccaggacagcctcctaaactgctcattaactgggcatctaccccggcaatccggggtccctgaacccgattcagtgcagcgggtctggggacagattcactctcacatcagcagctgcagcgtgagatgtgcngttattactgtctaactagtttcgttcggtcggttcggtcgacggaccgaagaggaagttacaacgaacgtaagtaggcgttcgtcgcgtaac

SEQ ID NO: 308129 - DNA, 523 bp, Homo sapiens
  misc_feature: GZ8MTXP01EH46P.9.12.B01.1.454.CMB.2.raw
  modified_base (422)..(422): a, c, t, g, unknown or other
  misc_feature (422)..(422): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
tcagtgatacgtctcacgaccggtgctcgatttagtagtgtagattccgcgggctctgggagaggagcccagcactgggattccgaggtgtttccattcagtgatctgcactgaacacagaggactcgccatggagtttgggctgagcgtggtttctgttagctatttaaaggtgtcagtgtgaggtgcagctggtggagtctgggggaggcttggtccagcctggggggtccctgaaactctcctgtgcagcctctggatacaccgtcagtagtaactccaatgaactgggtccgccaggctccagggaaggggctggagtgggtctcagttatttatagcggtggtaacacatactacgcaagactcgtgaaagggcagattcacatctcagagacaattcccaaggaacacgctgtatnttacaataagaacagctagagagcgagacgacgtctagtatattaatgttgngagagattgttgttacgtnttgtaatatcgttcgggtaacggaaggaag

SEQ ID NO: 308130 - DNA, 527 bp, Homo sapiens
  misc_feature: GZ8MTXP01ECB3H.9.12.B01.1.454.CMB.2.raw
  modified_base (355)..(355): a, c, t, g, unknown or other
  misc_feature (355)..(355): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctctaaactgctcattaactggcatctacccggcaatccggggtccctgaccgattcagtggcagcgggtctgggacagatttcactctcnccatcagcagcctgcaggctgaagatgtggctagtttattactgtcaactagttttcgtcggggggcgtttcggccgtaagggaccaagggtagaaatacaaacgtaacgtgtggctgcaccattctgtcttcttnttccttcccgcctntctgaagtaaccgttaacaacg

SEQ ID NO: 308131 - DNA, 534 bp, Homo sapiens
  misc_feature: GZ8MTXP01DZD7V.9.12.B01.1.454.CMB.2.raw
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctggtttcctgttgctatttaaagtgtcagtgtgaggtgcagctggtggagtctgggggaggcttggtccagcctggggggtccctgaaactctcctgtgcagcctctggatacaccgtcagtagtaactccatgaactgggtccgccaggctccaggggaaggggctggagtgggtctcagttatttatagcggtggtaaccacatactacgcaagactccgtgaagggcagattcacatctccggaanacatcagacncgctnatctanaaatgaacagctagagagcgagacgacggctagtatattagtgtgacgagagtattcggttcgttcgttacgttttaagattaacgtcggtacggggacctaagggaactaagg

SEQ ID NO: 308132 - DNA, 514 bp, Homo sapiens
  misc_feature: GZ8MTXP01DPPYR.9.12.B01.1.454.CMB.2.raw
  modified_base (243)..(243): a, c, t, g, unknown or other
  misc_feature (243)..(243): n is a, c, g, or t
  modified_base (337)..(337): a, c, t, g, unknown or other
  misc_feature (337)..(337): n is a, c, g, or t
  modified_base (395)..(395): a, c, t, g, unknown or other
  misc_feature (395)..(395): n is a, c, g, or t
  modified_base (410)..(412): a, c, t, g, unknown or other
  misc_feature (410)..(412): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcagaaaccaggacagcctacctaaaactgctcattaactgggcatctacccccggnaaatccggggtaccctgaacccgattcagtggcagcgggtctgggacagattcactcncaccatcagcagccnnngcgngagatgtgntagttatactgtctactacgttcgtcggtcgttcgtacgacgaacgaacgagaacgaacgaacgaacgtaacgtgcgacgtcgcgtaac

SEQ ID NO: 308133 - DNA, 538 bp, Homo sapiens
  misc_feature: GZ8MTXP01E2ZPU.9.12.B01.1.454.CMB.2.raw
  modified_base (317)..(317): a, c, t, g, unknown or other
  misc_feature (317)..(317): n is a, c, g, or t
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctactaaactgctcattaacnggcatctacccccggcaatcccggggtcctgaaccgattcagtggcagcgggtctgggacagatttcactctcaccatcagcagcctgcaggctgaagatgtggctagtttattacngttcaaactagttttcncggggtctttcgggacccgaaagggaacccgaaagggttacgggaaaattaccgaaaacgaacgtgtggcttggtccgaacgtaacg

SEQ ID NO: 308134 - DNA, 525 bp, Homo sapiens
  misc_feature: GZ8MTXP01EPDIH.9.12.B01.1.454.CMB.2.raw
  modified_base (400)..(400): a, c, t, g, unknown or other
  misc_feature (400)..(400): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (492)..(492): a, c, t, g, unknown or other
  misc_feature (492)..(492): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagaactccatgaactgggtccgccaggctccaggggaaggggctggagtgggtctcagtttatttatagcggtggtaaacacatactacgcagactccgtgaagggcagattcaccatctccaganacaattccaggaacacgctgtatcttcaaatgaaacnggctganagtcgaggcacggctgtatattactgtgcgagagatgtgttaacgttntttagaatgtcgtggggacaagggtaacaagtg

SEQ ID NO: 308135 - DNA, 546 bp, Homo sapiens
  misc_feature: GZ8MTXP01DMS6G.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaaacaagaactacttagcttggtatcagcaagaaaccaggacagcctactaaactgctcattaactggacatcctacccccggcaacgtcccggggtccctgaacccgattcgagtggcaggcgggtctgggacagtattcactctcaccatcagcacgcctgacaggctagaagatgtgctagtttattactgtcaacgtgttttcgcggggtcgttcgggaccgaaagggtacccgtaagggttacggaaagttaccaaacggtaactgtagggcttaggcaacctaa

SEQ ID NO: 308136 - DNA, 534 bp, Homo sapiens
  misc_feature: GZ8MTXP01CR8C8.9.12.B01.1.454.CMB.2.raw
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
  modified_base (530)..(530): a, c, t, g, unknown or other
  misc_feature (530)..(530): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcggtctcgggacagntttcactctcnccatcagcagcctgcaggctgaagatgtggctagtttatactgtcaaactagttttcncggggggtcgtttcgggaccctaaaggggacccaaagggtcggaaatacgaaaaccgtaatgtcggctgcaccgtattctgtcttcattccttcccgctaatctgaacgtcgttntccg

SEQ ID NO: 308137 - DNA, 633 bp, Homo sapiens
  misc_feature: GZ8MTXP01DA2XW.9.12.B01.1.454.CMB.2.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagcgtggtttcgtgtaggctatttaaagtgtcagtgtgaggtgcagctggtggagtctgggggagcttggtccagcctgggggtccctgaaactctctgtgcagcctctggatacaccgtnagtanacncatgacgtcggcgcagcncgagggaggntggagtggtctgtagtttattagtagcggtagtaaacactactactacgacacgacgtacgtaggaacggcaagtacttaccaacctacgtcctaccgaagaactaactaaactacgaacggaaacgaacgtacgttacgtaacttacttaactaaacgtaacgtaaacgaacgggtacgtacggaacggaacggtacggaacggaacgacggtacgtagttaattaacttacgttagtaaggtacggaggtaagttagtaggttacgttacgttcgtttagttaagttagtaacggtacggggtacgggaacgggtaacgttaacgtaacgg

SEQ ID NO: 308138 - DNA, 558 bp, Homo sapiens
  misc_feature: GZ8MTXP01DDEUJ.9.12.B01.1.454.CMB.2.raw
  modified_base (244)..(244): a, c, t, g, unknown or other
  misc_feature (244)..(244): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccaggacacgcctacctaaactgctcattaactgggcatcctaccccccggcaaacgtcccggggtccctgaacccgattcgagtggcaggcgggtctgggacagtatttcactctcaccatcagcagcctgcaggctagaagatgtgctagtttattactgtactaacgtgttttccgtcggggtcgttcgggacccgaaaggggtacccgtaagggttaggaaacttaccgaaaacgaacgtggtacggcttagccgaaccgtaacg

SEQ ID NO: 308139 - DNA, 519 bp, Homo sapiens
  misc_feature: GZ8MTXP01EYFLV.9.12.B01.1.454.CMB.2.raw
  modified_base (451)..(451): a, c, t, g, unknown or other
  misc_feature (451)..(451): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctcgacaacaagaactacttagcttggtatcagcagaaaccaggacagcctcctaaactgctcattaaactgggcatctacccccggcaatccggggtccctgaaccgattcagtggcagcgggtctggggacagatttcactctcaccatcagcagcctgcaggctgaagatgtggcagtttatactgtcaaactgttttcncgggtcgtttcgggcccaagggaccgaaaggttaggaaattacaaagactaagtgacttgcaacctaa

SEQ ID NO: 308140 - DNA, 524 bp, Homo sapiens
  misc_feature: GZ8MTXP01BGE11.9.12.B01.1.454.CMB.2.raw
  modified_base (244)..(244): a, c, t, g, unknown or other
  misc_feature (244)..(244): n is a, c, g, or t
  modified_base (451)..(451): a, c, t, g, unknown or other
  misc_feature (451)..(451): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcagaaaccaggacagcctcctaaactgctcattaactgggcatctacccccggcaatcccggggtccctgaaccgattcagtggcagcgggtctgggacagattcactctcaccatcagcagcctgcagggctgaagatgtggcagtttatactgtcaactagttttcncggggtcgttcggccgaacgggtaccgaaggttaggaaattacaaacgaacgtgtaggcgttgcaacccgtaa

SEQ ID NO: 308141 - DNA, 538 bp, Homo sapiens
  misc_feature: GZ8MTXP01EVKZ5.9.12.B01.1.454.CMB.2.raw
  modified_base (246)..(246): a, c, t, g, unknown or other
  misc_feature (246)..(246): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttanacggctccgacaacaagaactacttagcttggtatcagcaagaaaccaggacagccctacctaaactgactctaattaacgtgggcactcctaaccccccggcaaacgtcccgggggtccctgaacccgattcagtggcaggcgggtctgggacagtattcactctcacatcagcagcctgcaggctgaagatggtgctagtttatacgtgtcaattcgtttcgcgggtcgttcggccgaaagggaccgtaaggaggaacttacgaaacgataagtggacttgcaaccgtaa

SEQ ID NO: 308142 - DNA, 559 bp, Homo sapiens
  misc_feature: GZ8MTXP01A82RA.9.12.B01.1.454.CMB.2.raw
  modified_base (244)..(244): a, c, t, g, unknown or other
  misc_feature (244)..(244): n is a, c, g, or t
  modified_base (422)..(422): a, c, t, g, unknown or other
  misc_feature (422)..(422): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccaggacagcctacctaaactgctacattaactggacactcctacccccggcaaacgtcccgggggtccctggaacccgtattccgaggtcgggccagggtccgggtactaggggactagtactttcacttcnccaacccatcaagcagcctgcaggctagaagatgtgctagtttatacgtgtcaaacttgtttcgcgggtcgtttcggaccaagggaccaagggttaggaaacttacgaaaacgacgtgtaggcttagcgaacctaag

SEQ ID NO: 308143 - DNA, 577 bp, Homo sapiens
  misc_feature: GZ8MTXP01CQ68Y.9.12.B01.1.454.CMB.2.raw
  modified_base (376)..(376): a, c, t, g, unknown or other
  misc_feature (376)..(376): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
  modified_base (546)..(546): a, c, t, g, unknown or other
  misc_feature (546)..(546): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcgtgggtttccttgttgctatttaaaaggtgtccagtgtgaggtgcagctggtggagtcgtgggggaggcgttggtccagccgtggggggtccctgaaactctcctgtgcagcctctggatacaccgcagtagtaactccatgaactgggtcccgccgaggcctccgagggggaaggggcgtgggaggtgggtctcgtagtttatttagtaggcggtaggtaacanatactacgacagctccgtagaagggcagatacaccatctaccaagacgaactaacgttaccgaaggaaccacgcttagtactacttacaaatcgaacagccgtagagacgtacgaggacacggcttagtataattacgngtagnggaagngttagttggttgttaacgtnttttaagattgttcggtggggaaccgaaggg

SEQ ID NO: 308144 - DNA, 531 bp, Homo sapiens
  misc_feature: GZ8MTXP01AN9G1.9.12.B01.1.454.CMB.2.raw
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctcgacaacaagaactacttagcttggtatcagcaagaaaccaggacagcctacctaaactgctcattaactgggcatcctacccccggcaagtcccggggtccctgaacccgattcagtggcagcgggtctgggacagattcactctcacatcagcagcctgcaggctgaagatgtggctagtttattactgtactaactagttttctcgggtcgttcgggaccgaaagggaccgaagggttaggaaagttacgaaacgaactgtggacttcgcgaaccgtaa

SEQ ID NO: 308145 - DNA, 524 bp, Homo sapiens
  misc_feature: GZ8MTXP01C1EUC.9.12.B01.1.454.CMB.2.raw
  modified_base (243)..(243): a, c, t, g, unknown or other
  misc_feature (243)..(243): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcagaaaccaggacagcctctaaactgctcattaactggcatctacccccggcaatccggggtcctgaaccgattcagtgcagcgggtctgggacngtattcactcncaccatcagcagcctncaggctgaaagtntgngtctagttatacgtgtactacgttcgttcgcggtcgttacggaccgaaggaacgtaaggttagaacttaacgaaacgtacgtggtcgacttcgtaacaacgtaag

SEQ ID NO: 308146 - DNA, 552 bp, Homo sapiens
  misc_feature: GZ8MTXP01DX24Y.9.12.B01.1.454.CMB.2.raw
  modified_base (247)..(247): a, c, t, g, unknown or other
  misc_feature (247)..(247): n is a, c, g, or t
  modified_base (422)..(422): a, c, t, g, unknown or other
  misc_feature (422)..(422): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgcaagtccagccagagttgtttanacggctaccgacaaacaagaactacttagcttggatcagcaagaaaccaggacacgcctactaaactgctacaattaacgtggacatcctacccccggctaaacgtcccggggtccctgaacccgtattcgagtcggcaggcgggtctgggacagtattcactctacaccatcancagcctgacaggctagaagtatgtggcttagtttattactgtacaacgttcgtttcgcgggtcgttcggaccgttaaagggaccgtaaggttaggaaacttacgaaagactgtaggcttcgcaacgtaac

SEQ ID NO: 308147 - DNA, 633 bp, Homo sapiens
  misc_feature: GZ8MTXP01DZGIL.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaaggggctggagtgggtctcgtagttatttagtagcggtagtaaccgacatactacgcaagactccgtgaagggcagattcacatctaccagacgacaaacttccgaagggtaacacgtactaggttacttacttacaaaattcggaaaccgtaggtaccccttagggaagtaacggtccgaagggaaccgtacggggtccttaggttaataagtttaaccgttggttacggcggttaaggagtagttaggttcggttaccgtaagtttttgaacgtttacgtcggttacgggggaacccttaaagggggtaacc

SEQ ID NO: 308148 - DNA, 684 bp, Homo sapiens
  misc_feature: GZ8MTXP01CH3UV.9.12.B01.1.454.CMB.2.raw
  modified_base (249)..(249): a, c, t, g, unknown or other
  misc_feature (249)..(249): n is a, c, g, or t
  modified_base (498)..(498): a, c, t, g, unknown or other
  misc_feature (498)..(498): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgtttanacggctaccgaacaaacaagaactacttagcttggtatcagacaaagaaaccaggacacgaccctacctaaactcgacctactaagttaacgtgggactacgtcccgtaacccccccggactaacggttccccgggggtccctacggtaaaccccgtatttcccgaagggtcgggaccgtagggtccggggtacgtagggaacctagtactttacgaccttcctaccaacccatccagccacggtcccngacgaggtacgtaaggaagtgttcggtacgttacttaagtttacgttacgttacgtaacctaacgtttcggtttccgggtccgggttcgttaccgggtaaccgaaacggggtaacgtaacgggttaaacgaaacgttaaccgtaaacggtacgttggtacggaccgttacgtaacccgttaacgtg

SEQ ID NO: 308149 - DNA, 542 bp, Homo sapiens
  misc_feature: GZ8MTXP01DBX5P.9.12.B01.1.454.CMB.2.raw
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (512)..(512): a, c, t, g, unknown or other
  misc_feature (512)..(512): n is a, c, g, or t
  modified_base (524)..(524): a, c, t, g, unknown or other
  misc_feature (524)..(524): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagaactccatgaactgggtccgccaggctccgaggggaaggggctggagtgggtctcagtttattagtagcggtaggtaacactactactacgcagactaccgtagaagggcagattcaccatctaccagagacaattccaaggaacaacgctagtatcttacaaaatgaaacnggcctagagagtcgagacacggctagtatattacngtgngttagnagtcgtgttaccgtttnttagaatgtcgngggacaggtaacaagtcg

SEQ ID NO: 308150 - DNA, 558 bp, Homo sapiens
  misc_feature: GZ8MTXP01AQZKO.9.12.B01.1.454.CMB.2.raw
  modified_base (245)..(245): a, c, t, g, unknown or other
  misc_feature (245)..(245): n is a, c, g, or t
  modified_base (452)..(452): a, c, t, g, unknown or other
  misc_feature (452)..(452): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaacaagaactactagcttaggtatcagcaagaaaccaggacagccctacctaaactgactacattaacgtgggacactccgtaccccccggctaaacgtcccgggggtaccctgaaacccgtattcgaggtggcagggcgggtctggggacagtactttcgactctacacatcagcagcctgacaggctagaaagntggtggctagtttatactgtactaacgttgtttcgcgggtcgttcggaccgaaagggaccaagggttagaaattacgaaacgacgtggtagcttacgcaaccgtaa

SEQ ID NO: 308151 - DNA, 568 bp, Homo sapiens
  misc_feature: GZ8MTXP01BAGU1.9.12.B01.1.454.CMB.2.raw
  modified_base (367)..(367): a, c, t, g, unknown or other
  misc_feature (367)..(367): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctactaaactgctcattaactgggcatcctaccccggcaacgtcccggggtccctgaccgattcgagtggcaggcgggtctcgggacagtatttccactctcncatcagcagcctgcaggctaggaagatgtggactaagtttatactgtactaacgtagttttcgcgggggtacgttacggaaccgaaacggggtaccaaagggttacgaaagttacgaaacgtaactggtacggctcggccacgtattcgtacgtcttcacttccttcccgcctaacttacgtagaacgtcgttaataaccg

SEQ ID NO: 308152 - DNA, 528 bp, Homo sapiens
  misc_feature: GZ8MTXP01A4SSK.9.12.B01.1.454.CMB.2.raw
  modified_base (498)..(498): a, c, t, g, unknown or other
  misc_feature (498)..(498): n is a, c, g, or t
tcagtgatacgtctcacgaccggtgctcgatttagtagtgtagattccgcggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccgaggggaaggggctggagtgggtctcagttatttatagcggtggtaaccacatactacgcaagactccgtgaagggcagattcacatctcagagacaatccaggacacgctgatctacaaatggaacagcctagagagtcgaggacacggctgtatattaactgttgcgagagattggttgttacgttntttgaattgtcggttgggaacgaagggaac

SEQ ID NO: 308153 - DNA, 530 bp, Homo sapiens
  misc_feature: GZ8MTXP01D5TVH.9.12.B01.1.454.CMB.2.raw
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacacgtcagtagtaactccatgaactgggtccgccaggctccgaggggaagggctgggagtgggtctcgtagtttattagtagcggtaggtaacacatactacgacagctcgtgaagggcagattcacatcncaganacaattccgagacacgctgtatcttacaaaatgaaacacgcctagagngtacggaagacaacggctgtataattangtgngagagagttgttgtaacgttntttgatgttcgtgggaacgaagg

SEQ ID NO: 308154 - DNA, 514 bp, Homo sapiens
  misc_feature: GZ8MTXP01AOTOY.9.12.B01.1.454.CMB.2.raw
  modified_base (409)..(409): a, c, t, g, unknown or other
  misc_feature (409)..(409): n is a, c, g, or t
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctcgacaacaagaactactagcttggatcagcagaaaccaggacagcctactaaactgctcattaactggcatctacccccggcaatcccggggtcctgaacccgattcagtggcagcgggtctgggacagattcactctcaccatcagcagcctgcagcgngaagagtgtgcgtagttattactgtctaactagtttcgtcggtcgttcgtcgacggaccgaaggttaggaagttacgaacgaacgtaagtagcgcgtcgcgtaac

SEQ ID NO: 308155 - DNA, 517 bp, Homo sapiens
  misc_feature: GZ8MTXP01DL6O9.9.12.B01.1.454.CMB.2.raw
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
  modified_base (467)..(467): a, c, t, g, unknown or other
  misc_feature (467)..(467): n is a, c, g, or t
  modified_base (488)..(488): a, c, t, g, unknown or other
  misc_feature (488)..(488): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctctaaactgctcattaactggcatctacccggcaatccgggggtccctgaccgatttcagtggcagcgggcctgggacagatttcactctcnccatcagcagcctgcaggctgaagatgtggcagtttatactgtacaactagttttcncggggggcgtttcggaccaaggggaccaaggtggaaatacaaacgtaactgnggctgcaccattctgtcttcnttccttcccgctaatctgaagcgttaatc

SEQ ID NO: 308156 - DNA, 593 bp, Homo sapiens
  misc_feature: GZ8MTXP01DYCZG.9.12.B01.1.454.CMB.2.raw
  modified_base (246)..(246): a, c, t, g, unknown or other
  misc_feature (246)..(246): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttanacggctccgacaacaagaactacttagcttggtatcagacaagaaaccaggacacgaccctactaaactgactactaattaacgtgggacatcccgtaccccccggactaaacgtcccgggggtccctacggaacccgtattccgagtcgggcaggcggggtctggggacagtatttcactctacacatcagcagcctgcaggctagaagatggtgctagtttattactgtactaaacgttgtttcgcgggtcttacgggaccgaaacgggtaaccgtaagggttaagttaaacgttaccgaaaaccgtaaacgtggttcgggacttacggaaccttaaccgtaacg

SEQ ID NO: 308157 - DNA, 549 bp, Homo sapiens
  misc_feature: GZ8MTXP01BEX74.9.12.B01.1.454.CMB.2.raw
  modified_base (245)..(245): a, c, t, g, unknown or other
  misc_feature (245)..(245): n is a, c, g, or t
  modified_base (314)..(314): a, c, t, g, unknown or other
  misc_feature (314)..(314): n is a, c, g, or t
  modified_base (395)..(395): a, c, t, g, unknown or other
  misc_feature (395)..(395): n is a, c, g, or t
  modified_base (468)..(468): a, c, t, g, unknown or other
  misc_feature (468)..(468): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaacaagaactacttagcttggtatcagcaagaaaccaggacagcctactaaactgctnattaactggcatcctacccccggcaaacgtcccggggtccctgaacccgattcgagtgggcaggcggggtctgggacagtntttcactctcacatcagcagcctgacaggcgtagaagatggtggctagtttatacctgtctaactagttttcncggggtcttacgggaccgaaaggggtaccaagggttacgggaaattacgaaaacgacgtgtagggcttagccgaacctaag

SEQ ID NO: 308158 - DNA, 535 bp, Homo sapiens
  misc_feature: GZ8MTXP01DXTRZ.9.12.B01.1.454.CMB.2.raw
  modified_base (357)..(357): a, c, t, g, unknown or other
  misc_feature (357)..(357): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctcctaaactgctcattaactggcatctacccgcaactccggggtccctgaccgattcagtggcagcgggtctcgggacagatttcactctcnccatcagcagcctgcaggctgaagatgtggactagtttatactgtactaaactgtttcgcgggggtcgttcggaccgaacgggaccgaaaggtaggaaagtacaaacgtaactgtaggctgacaccattctgtcttacgacttcctcccgccaactctacgaagtaacgttaacaacg

SEQ ID NO: 308159 - DNA, 529 bp, Homo sapiens
  misc_feature: GZ8MTXP01A91WP.9.12.B01.1.454.CMB.2.raw
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
  modified_base (441)..(442): a, c, t, g, unknown or other
  misc_feature (441)..(442): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
tcagtgatacgtctcacgaccggtgctcgatttagtagtgtagattccgcggggctctgggagaggagcccagcactgggattccgaggtgtttccattcagtgatctgcactgaacacagaggactcgccatggagtttgggctgagcgtggtttcgtgtagctatttaaaggtgtcagtgtgaggtgcagctggtggagtcgtgggggaggcttggtccagccgtggggggtccctgaaactctcctgtgcagcctctggatacaccgtcagtagtaactccatgaactgggtccgccaggctccgaggggaagggggctgggagtgggtctctagttatttatagcggtaggtaaccacatactacgcaagactccgtgaagggcagattcacatcncaganacaattccaaggacagctgtatcttaanaangaacnncagagngngagacncgtntgtatntngngacgagagtgttcgttgttacgttntttagaattcgtcggacggggaacgaagggtaac

SEQ ID NO: 308160 - DNA, 547 bp, Homo sapiens
  misc_feature: GZ8MTXP01DNANX.9.12.B01.1.454.CMB.2.raw
  modified_base (492)..(492): a, c, t, g, unknown or other
  misc_feature (492)..(492): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccagccgtggggggtccctgaactctcctgtgcagcctctggatacaccgtcagtagtaactccatgaactgggtcccgccaggctccgaggggaaggggctgggagtgggtctcgtagtttatttagtagcggtaggtaacactactactacgcagactaccgtgaagggcagattcaccatctcagagacaatccaaggaacacgctagtatcttacaaatgaacaggcctgagagtcgagacaggctgtaatattactggtgcgagagngtgtgttacgttcttttagaattagtcggtggggaccaaggggtaacaagttcgg

SEQ ID NO: 308161 - DNA, 611 bp, Homo sapiens
  misc_feature: GZ8MTXP01D29E9.9.12.B01.1.454.CMB.2.raw
  modified_base (554)..(554): a, c, t, g, unknown or other
  misc_feature (554)..(554): n is a, c, g, or t
  modified_base (583)..(583): a, c, t, g, unknown or other
  misc_feature (583)..(583): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggtttccttgttgctatttaaaggtgtcagtgtgaggtgcagctggtggagtcgtgggggaggcttggtccagccgtgggggtccctgaaactctcctgtgcagcctctggatacaccgtcagtaagtaactccatgaacgtcgggtccgccaggctccggaggggaaggggctgggagtgggtctcgtagtttattagtaggtcggtaggtaaacactaactacgtacgacaagtccgtccggtaggaacggggacaggtacttcacctattccaccaaggacaactaaacgttacccgaaaggaaacctacgacttacgtaacttactttaacaaaattcgaaacgtacgaccgtaggaacgagtaccggaaggacctaccgggattgtaataattacngtgcgtaagagttattgttagtaacgttntttgagtattcggtgggaaccgtaaggg

SEQ ID NO: 308162 - DNA, 596 bp, Homo sapiens
  misc_feature: GZ8MTXP01BDY8L.9.12.B01.1.454.CMB.2.raw
  modified_base (461)..(461): a, c, t, g, unknown or other
  misc_feature (461)..(461): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctaccgaggggaaggggcgtggaggtgggtctcgtagttatttagtagcggtaggtaaccacatactacgcaagactccggtagaagggcagattcacatctacagacgacaacttcgaaggaacacgctagtatcttaacaaatgggaaacngtacctaggaagacgtacgaaggaccacggtctagtactagttaacgtggttggagaagagtacgttaggttcggttaaccgttgtttttggaatttacggtcgggttacgggggaacccgttaagggggtaacc

SEQ ID NO: 308163 - DNA, 805 bp, Homo sapiens
  misc_feature: GZ8MTXP01CNHUL.9.12.B01.1.454.CMB.2.raw
  modified_base (247)..(247): a, c, t, g, unknown or other
  misc_feature (247)..(247): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagtagttgtttanacggctccgacaaacaagaactacttagcttaggtatcgagacaagaaaccaggacagaccctacctaaactgaccttacaatttaaacgtcggggactaacgtacccgtaacccccccgggactaaacggttccccgggggttacccctacggaaacccccgttaatttcccgaaagggttcgggaccgtaacgggtcccgggggttacgtagggggaaaccctaaggttacttttaccaaccgttcctacccaacccgtaattcccgaaagtcccgaacgccccgttggaccgaacgggtaccgttaagggaaaacggtacgttgggttacggtacccgtttaaagggttttttaactttaaaccgttgttaaaccgttaaaaccgtttacgggttttttcccggtaaccgggggtacccggttttaccggggaccccggttaaaacggggaaaccccggtaaaggggttaaacggggttaaaacttaaacccggaaaaacgggtaaaccggttgggttaacgggtccttaccgggaaccgttaaccccgttaacg

SEQ ID NO: 308164 - DNA, 589 bp, Homo sapiens
  misc_feature: GZ8MTXP01EBTSB.9.12.B01.1.454.CMB.2.raw
  modified_base (248)..(248): a, c, t, g, unknown or other
  misc_feature (248)..(248): n is a, c, g, or t
tcagtgatacgtctcacgaccggtgctcgatttagtagtgtagattccgcggggattgtgaagtgagctacaacaggcaggcagggggcagcaagatggtgttgcagacccaggtcttcatttctctgttgctctggatctctggtgcctacggggacatcgtgatgacccagtctccagactccctggctgtgtctctgggcgagacgggccaccgatcaactgcaagtccagccagagttgtttanacggctccgacaacaagaactacttagcttggtatcagcaagaaaccaggacagcctactaaactgactacattaactgggcatcctacccccggcaacgtcccggggtccctggaacccgattcgagtgggcagcgggtctagggacagatttcactctacaccatcagcagcctgacagggctagaagtgtggtggaccttagtttacttaacctgtactaaacgttcggttttccgcggggtcgttcccggacgaaacggggaacccgtaagggttaacggaaacttaccgaaaaccgtaacgtcggtaggccggttagaacccgttaacgttaaccg

SEQ ID NO: 308165 - DNA, 571 bp, Homo sapiens
  misc_feature: GZ8MTXP01EES27.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgaacaaacaagaactacttagcttggtatcagacaagaaaccaggacacgcctacctaaactgctacattaactggcactcctacccccggctaacgtcccggggtccctcgaacccgattcgagtcgggcaggcgggtcgtggggacagtatttcactctcacatcagcagcctgacagggactagaagtagtgtggtctaagttttactactgtactaaacgttgttttcgcgggtcgttcggacccgttaaagggaaccgtaagggttacgaaacttaccgaaacgtaacgtggtggacttcgaaccaaccgtaa

SEQ ID NO: 308166 - DNA, 520 bp, Homo sapiens
  misc_feature: GZ8MTXP01EQ6VD.9.12.B01.1.454.CMB.2.raw
  modified_base (355)..(355): a, c, t, g, unknown or other
  misc_feature (355)..(355): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctctaaactgctcattaactggcatctacccggcaactccggggtcctgaccgattcagtggcagcggtctgggacagatttcactctcnccatcagcagcctgcaggctgaagatgtggtacagttttatactagtcaactagttttcgcggggggcgtttcggccgaaagggaccaaaggtggaaaatacaaaacgaactgtggctaagcttaccattcgtntcttcnttcttccgcaatctgagcgttaatc

SEQ ID NO: 308167 - DNA, 533 bp, Homo sapiens
  misc_feature: GZ8MTXP01CMV56.9.12.B01.1.454.CMB.2.raw
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggctccgaggggaaggggctggagtgggtctcagttattatagcggtggtaaccacatactacgcaagactccgtgaagggcagatcacatctcagagacaattccaaggaacacgctagtatcttanaaatggaacagcctagagagtcgaggacncggtctgtatntaactgttgcgagagtnttgttgttacgttnttgaatgtcggagggaacgaagggtaa

SEQ ID NO: 308168 - DNA, 560 bp, Homo sapiens
  misc_feature: GZ8MTXP01D40FC.9.12.B01.1.454.CMB.2.raw
  modified_base (522)..(522): a, c, t, g, unknown or other
  misc_feature (522)..(522): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccagccgtggggggtccctgaaactctcctgtgcagcctctggatacaccgtcagtagaactccatgaactgggtcccgccaggctccgaggggaagggcgtgggaggtggggtctcgtagtttatttagtagtcggtaggtaaacacacgtactacgcagacctaccgtgaagggcagattcacctatcgtccagagacaactccaggaacacggtctatatcttacaaatgaacagggcctgaagcgtcgaagacgacggtatgtaatactgtgtgagaggattacgtgtcgttacgttntttgaatgtcggtacgggacgaaggtaacgttaagtcg

SEQ ID NO: 308169 - DNA, 604 bp, Homo sapiens
  misc_feature: GZ8MTXP01C15EK.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctacctaaactgactcattaactggcatctacccggcaactcccggggtcctgaccgattcagtggcagcgggtctgggacagatttcactctacaacccatcagcagcctagcaggctagaagtatgtggactagtttatactgtacaacgtacgtttcgcggggggtcgtttaccgggacccgaaaggggtaccctaaaggggtcggaaaacgttaccgaaaacgtaacgtcggtgggctaacggccaaccctaattccgttacggttcccttaacgttccttccctttccccggaccctaataccgttagaaacgttaacccggttaataacccgg

SEQ ID NO: 308170 - DNA, 540 bp, Homo sapiens
  misc_feature: GZ8MTXP01DNUTZ.9.12.B01.1.454.CMB.2.raw
  modified_base (462)..(462): a, c, t, g, unknown or other
  misc_feature (462)..(462): n is a, c, g, or t
  modified_base (489)..(489): a, c, t, g, unknown or other
  misc_feature (489)..(489): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaaggggcgtgggagtgggtctcgtagtttatttagtagtcggtaggtaacactactactacgcagactcccgtagaagggcagattcaccatctccagagacaatcgaggaacacgctgtatcttacaaatagaacaggacctgaagngtagaggacacggatgtatatctgtgngagagagtgtgttagttctttagaatatcgtgggaccgaggcttaagtcgg

SEQ ID NO: 308171 - DNA, 539 bp, Homo sapiens
  misc_feature: GZ8MTXP01BACXD.9.12.B01.1.454.CMB.2.raw
  modified_base (245)..(245): a, c, t, g, unknown or other
  misc_feature (245)..(245): n is a, c, g, or t
  modified_base (527)..(527): a, c, t, g, unknown or other
  misc_feature (527)..(527): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaaacaagaactacttagcttaggtatcagcagaaaccaggacagcctacctaaactgctcattaacgtgggacatcctacccccggactaacgtcccggggtccctgaacccgattcagtgggcaggcgggtctgggacagtatttcactctacacatcagcagcctgcaggctagaagagtgtaggctagtttatactgtacaactgttttcgcggggtcgttcgggaccgttaggggaaccaaggttaggaattacaaacgacgtgtgnttcgcaacgtaa

SEQ ID NO: 308172 - DNA, 545 bp, Homo sapiens
  misc_feature: GZ8MTXP01CKTQG.9.12.B01.1.454.CMB.2.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaaacaagaactacttagcttggtatcagcaagaaaccaggacagccctacctaaactgactacatttaacngggcatcctaaccccccggnaacgtcccggggtccctgaacccgattccgagtggacaggcgggtctgggacagtatttcactctcacatcagcagcctgcaggctagaagatggtgactagtttattactgtactaactgttttcgcgggtcgttcgggaccgaaacgggaaccgaaggttagaaacttacgaaacgactgtggcttcgccaacctaa

SEQ ID NO: 308173 - DNA, 589 bp, Homo sapiens
  misc_feature: GZ8MTXP01C8V2D.9.12.B01.1.454.CMB.2.raw
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (445)..(445): a, c, t, g, unknown or other
  misc_feature (445)..(445): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttanacggctaccgaacaaacaaagaactacttagcttggtatcagcaaagaaaccaggacagcctactaaactgctanaattaacgngggacatccgtaacccccggcaacgtcccggggtccctgaaacccgtattcgagtggcaggcgggtactgggacagtattcactctcacatcagcagcctgacaggctagaaagntgtggacttagtttattactgtactaaacgttcgttttcgaaccggggtcgtttaccgggaccgaaacggggtaacccgaaagggttacgaaaacgttaccgaaaacgtaacgttggtaacgggtcttacggccaacccgttaa

SEQ ID NO: 308174 - DNA, 559 bp, Homo sapiens
  misc_feature: GZ8MTXP01BJ6FQ.9.12.B01.1.454.CMB.2.raw
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggtttccttgttgctatttaaaaggtgtccagtgtgaggtgcagctggtggagtcgtgggggaggcttggtccaggccgtggggggtccctgaaactctcctgtgcagcctctggatacaccgtcagtagtaactccatgaactggtccgccaggctccgagggaaggggcgtggagtgggtctcgtagtttatttagtaggtccggtaggtaacacatactaacgcaagactccgtagaagggcagacttcacatcctccgagagacaacttccgaaggaacacgctagtacttcttacgaaatcgaaacacgacctagagagtacggagtaccacggtctagtaatattacgtgttgcgaagngttnttgtgtacgtnttttgattagtcgttggggaaccg

SEQ ID NO: 308175 - DNA, 608 bp, Homo sapiens
  misc_feature: GZ8MTXP01DHPCA.9.12.B01.1.454.CMB.2.raw
  modified_base (541)..(541): a, c, t, g, unknown or other
  misc_feature (541)..(541): n is a, c, g, or t
  modified_base (559)..(559): a, c, t, g, unknown or other
  misc_feature (559)..(559): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggagggctggaggtggtctcagtttattataggcggtggtaaccacatactacgcaagactccgtagaagggcagacttcacatctccagacgactaaacttcccgaaaggaaccacggtctagtaacttacttaacaaaatagggaaaccaggtaccctaggaaggacggtacgaacggtaacacggtcttagtaattacttaacgtggttgacggaagtagtnttggttcgttaacgtttnttttaggaatttacggtcggttacgggggaacccttaaagggggtaacc

SEQ ID NO: 308176 - DNA, 668 bp, Homo sapiens
  misc_feature: GZ8MTXP01C8RTX.9.12.B01.1.454.CMB.2.raw
  modified_base (246)..(246): a, c, t, g, unknown or other
  misc_feature (246)..(246): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgtttanacggctccgaacaacaagaactacttagcttggtatcagcaaagaaacccaggacacgtccctactaaactgaccttacaatttaacgtgggactactaccccgtaccccccggactaaacggtccccgggggtccctacggaaaccccgtatttccggaggttcgggccgtacggggtccggggttcgtagggggaacctagtactttccaacttctaccacctaatcagccaggccctgacgaggtcgtaggtaagtagttggtaggtaccttaagtttttacttaacgttcgttacctaaacgttcggtttttccggaaccggggttccgttacgggaccccgttaaaggggtaacccgtaagggttaacggttaaacttaccgaaaacgtacgtggtacgcttacgtccaacgttaac

SEQ ID NO: 308177 - DNA, 554 bp, Homo sapiens
  misc_feature: GZ8MTXP01E4NOH.9.12.B01.1.454.CMB.2.raw
  modified_base (346)..(346): a, c, t, g, unknown or other
  misc_feature (346)..(346): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcgttggtccaggccgtggggggtccctgaaactctcctgtgcagcctctggatacaccgtcagtagtaactccatgaactgggtccgccgaggctccgaggggaagggggctgggagtgggtctntagttatttagtagccggtaggtaacactatactaacgcaagactccgtgagggcagatcacatcncanagacaatcagacngctgatctacaaatgaaacagacctaggacgtaggtaccgaaggaccacgggtcctggtaatacttacgtgttcggacgtaggagttagttggtgtcgtgttttagattagtcggttggggaaccg

SEQ ID NO: 308178 - DNA, 537 bp, Homo sapiens
  misc_feature: GZ8MTXP01DKYD6.9.12.B01.1.454.CMB.2.raw
  modified_base (366)..(366): a, c, t, g, unknown or other
  misc_feature (366)..(366): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcaagaaaccaggacagcctcctaaactgctcattaactgggcatcctacccggcaacgtcccgggggtccctgaccgatttcagtggcaggcgggtctgggacagatttcactctcnccatcagcagcctgcagctagaagatgtggactagtttattactgtacaatagtttcgtcggggggtcgttcgggaccaaaggggaccgaaaggtgaaatacgaaacgtactagtcggctgcacattctgtcttcgcttccttcccgcaatctagacgtaacgttaatccg

SEQ ID NO: 308179 - DNA, 652 bp, Homo sapiens
  misc_feature: GZ8MTXP01BKJZ7.9.12.B01.1.454.CMB.2.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (346)..(346): a, c, t, g, unknown or other
  misc_feature (346)..(346): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgagacggccaccatcaactgacaagtccagccagtagttgtttanacggctaccgaanaaacaagaactacttagcttaggatacagacaaagaaaccaggaacacgtaccctacctaaactcgactactaatttaaacgnggactacgtacccgtaaccccccggactaaaccggttcccggggtccctacggtaaacccgttaattccgaagggttcgggaccgtagggtccgggtacgtagggactagtactttcactctaccaactatcagccacggccctagacgaaggtcgtaaggaaagtgtcggtaggtacttaaggtttacttacgtgtaactaacgttcgttttcggcgggttcgttacggaccgaaacgggtaaaccgaagggttaacgaaacttaacgaaacgtacgtggtacgcgttacaaccgaaccgttaag

SEQ ID NO: 308180 - DNA, 576 bp, Homo sapiens
  misc_feature: GZ8MTXP01AHS5D.9.12.B01.1.454.CMB.2.raw
  modified_base (360)..(360): a, c, t, g, unknown or other
  misc_feature (360)..(360): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaacaggacagcctctaaactgctcataactgggcatctacccggcaactccgggggtccctgaccgattcagtggcagcgggtcgtcggggcagactttcactctcncccatcagcagcctgcaggctagaagatgtggactagtttattactgttactaacgtcgttttcgcggggggtcgttcgggaccgaaacggggaacctaaggggtacggaaaacgtacgaaaacggtactacggtacggctaacggcacctacttctacgtccttcttacttcccttaacccgcctaacgtctacgaacgtaacgttaagtaaccg

SEQ ID NO: 308181 - DNA, 543 bp, Homo sapiens
  misc_feature: GZ8MTXP01BP8P3.9.12.B01.1.454.CMB.2.raw
  modified_base (246)..(246): a, c, t, g, unknown or other
  misc_feature (246)..(246): n is a, c, g, or t
  modified_base (436)..(436): a, c, t, g, unknown or other
  misc_feature (436)..(436): n is a, c, g, or t
  modified_base (535)..(535): a, c, t, g, unknown or other
  misc_feature (535)..(535): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttanacggctccgacaacaagactacttagcttggatcagcaagaaaccaggacacgcctacctaaactgacctcaatttaactgggacatcctacccccggcaagtcccggggtccctgaaccctattcgagtgggcagcgggtctgggacagtattcactctcacatcagcagcctgcaggctagaagatgnggctagtttactactgtcaacgttgttttccgcgggtcgttcggaccgagggaacctaaggggttaggaaacttacgaaaagcgtaaggtcggcttgcncccttaag

SEQ ID NO: 308182 - DNA, 689 bp, Homo sapiens
  misc_feature: GZ8MTXP01DWAUV.9.12.B01.1.454.CMB.2.raw
  modified_base (196)..(196): a, c, t, g, unknown or other
  misc_feature (196)..(196): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
tcagtgatacgtctcacgaccggtgctcgatttagtagtgtagattccgcgggcgtagactttgtgtttctcgtagtctgctgctcagcgtcagggtgctgctgaggctgtaggtgctgtccttgctgtcctgctctgtgacactctcctgggagttacccgattggagacgggccaccatcaactgcaagtccanccagtagtgtttcgacgcctccgaacaacaagaacttacttagtcttaggtactacacgacaaacgaaaccgacgacacgccctaacctaaactgacctataacttaacggtcggactacctacccgtaccccggactaaccgggtccccgggtaccgtacggaccgtacttacgtacggtcggacgacggggtccgggttcggtcggggactagtacttttaccaccctacttacccaactacaccgancccgacgttccgnacgggacggtagttaaggaagtagtttcgggtagttaccgttaagtttaacttacgtctaactaacgtttcgtttaccggccgggggttcggtaccggtacgggaaccgtaaacggtacgggtaaacgtaaacgtaacggaaacctacgtaggtacgtcgaacgtaccttaccacttcgttctccttacttcgttcccttccgactcgtctagacgtcttaagttaaccg

SEQ ID NO: 308183 - DNA, 662 bp, Homo sapiens
  misc_feature: GZ8MTXP01ESF4S.9.12.B01.1.454.CMB.2.raw
  modified_base (251)..(251): a, c, t, g, unknown or other
  misc_feature (251)..(251): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacgggccaccatcaactgcaagtccagccaggtagttgtttanacggctaccgaacaaacaagaactacttagcttaggtatcagacaacgaaaccgaggaacacgccctaactaaactcgactactaattaaacgtgggactacgtccgtaaccccccggctaaacggtcccggggtaccctcggaaacccgtattccgaggtcgggaccgtagggtccggggttcgaggggaactagtacttttccaaccttctaccacctaacgtccaagccacggccctggaccgagggacttaggaaagtgtggtacggtcttaaggttttacttaccgtgttacctaaacgttcgttttcggcgggttccgttacgggaccgttaaacgggaccgtaaagggttacgaaacttaaccgaaacggacgttggtacggcttacgaaccgttaacgtaacg

SEQ ID NO: 308184 - DNA, 574 bp, Homo sapiens
  misc_feature: GZ8MTXP01AZ5K7.9.12.B01.1.454.CMB.2.raw
  modified_base (503)..(503): a, c, t, g, unknown or other
  misc_feature (503)..(503): n is a, c, g, or t
  modified_base (528)..(528): a, c, t, g, unknown or other
  misc_feature (528)..(528): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctctgatacacgtcagtacgaactcatgaacgtcgggtccgccgaggcctccgaggggaaggggcgtgggaggtggggtctcgagtttatttagtaggcggtaggtaaacacactactacgcacgactaccggtagaagggcagtattcacctatctaccagaagacaacttccgaaggaacacgcttagtatcttacaaatgaacacggctaggagagtcgaggacacggctgtaattatacgtgngcgagagttgttggtgttaccgttnttttagaattagtcggtggggtaccaaggggtaaccttaagtccgg

SEQ ID NO: 308185 - DNA, 539 bp, Homo sapiens
  misc_feature: GZ8MTXP01ED0CW.9.12.B01.1.454.CMB.2.raw
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
  modified_base (517)..(517): a, c, t, g, unknown or other
  misc_feature (517)..(517): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttcctgttgctatttaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggctccgaggggaaggggctggagtgggtctcagttatttatagcggtaggtaaccacgatactacgcaagactccggtagaaggggcagattcacatctcagagacatccaaggaacacgctgtatctacaaatggaaacagcctagagagtcgagacncggnttgtaatntaactgttgngagagtattggttgttagtctttagaattancggttgggaaccgaagggtaac

SEQ ID NO: 308186 - DNA, 549 bp, Homo sapiens
  misc_feature: GZ8MTXP01B5E1T.9.12.B01.1.454.CMB.2.raw
  modified_base (245)..(245): a, c, t, g, unknown or other
  misc_feature (245)..(245): n is a, c, g, or t
  modified_base (549)..(549): a, c, t, g, unknown or other
  misc_feature (549)..(549): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaacaagaactacttagcttggtatcagcaagaaaccaggacacgccctacctaaactgctacaattaacgtgggcatccgtaccccccggcaacgtcccggggtcccctggaacccgtattcgaggtcgggcaggccggggtctggggacagtatttccactctcaccatcagcagcctgacgaggcgtagaagatgtggctagtttattactgtactagttcgtttcgtcgggtcgttcggacgaagggaccgaaggttaggaattacgaaacgactgtggcttgccaactn

SEQ ID NO: 308187 - DNA, 532 bp, Homo sapiens
  misc_feature: GZ8MTXP01BNBPA.9.12.B01.1.454.CMB.2.raw
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
  modified_base (500)..(500): a, c, t, g, unknown or other
  misc_feature (500)..(500): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactggtccgcaggctccgaggggaggggctggagtgggtctcagtttattatagcggtggtaaccacatactacgcaagactccgtgaagggcagattcacatctcagagacaattccaaggacacgctgtatcttacaaatggaacagcctgagngtcgaggacacggtctagtatntaactgttgcgagagattggttgttacgtnttttgaattatcgttaggggccaaggggtaac

SEQ ID NO: 308188 - DNA, 734 bp, Homo sapiens
  misc_feature: GZ8MTXP01ETGYH.9.12.B01.1.454.CMB.2.raw
  modified_base (251)..(251): a, c, t, g, unknown or other
  misc_feature (251)..(251): n is a, c, g, or t
  modified_base (339)..(339): a, c, t, g, unknown or other
  misc_feature (339)..(339): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacgggccaccatcaactgacaagtccagccagtagttgtttanacggctaccgaacaaacaagaactacttagcttaggatcagcaagaaaccaggacacgccctactaaactcgactactaagttaacgnggacaacgtcccgtaaccccccgggactaaacggttccccgggggtaccctacggaaaccccgtaagtttcccgaagggtcgggacccgacggggtcccgggggttacgtagggggtaaaccctaggttacttttcccaaaccttcctaccaaacctattccaacgccgaacgccccgtaggaccgaggggtactaagggtaaagtgtggttacggtactttaggtttttaactaccgttcgtaacctaaacgtttcgggtttttcccggaacgggggtttccgtttaccgggaaaccggttaaacggggtaacccgtaaaaggggttacggttaaaacgttacgtaaaaccgggtacgttgggtacggtacgacggtaacccgttaacttaacg

SEQ ID NO: 308189 - DNA, 546 bp, Homo sapiens
  misc_feature: GZ8MTXP01ESF3M.9.12.B01.1.454.CMB.2.raw
  modified_base (509)..(509): a, c, t, g, unknown or other
  misc_feature (509)..(509): n is a, c, g, or t
  modified_base (541)..(541): a, c, t, g, unknown or other
  misc_feature (541)..(541): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcaagaaaccaggacagcctacctaaactgctcattaactgggcatcctaccccggcaacgtcccgggggtccctgaccgattcagtggcagcgggtctgggacagatttcactctcaaccatcagcagcctgcaggctagaagatgtggtactagttttatacctgtactaaactagttttcgcggggggtcgttcgggaccgaaagggaccgaaggtagaaatacgaaacgtactgtcggctgcacattctagtcttcncttccttcccgctaactctacgagtaacgttntaacg

SEQ ID NO: 308190 - DNA, 553 bp, Homo sapiens
  misc_feature: GZ8MTXP01AJ58F.9.12.B01.1.454.CMB.2.raw
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactggcatctacccggcaacgtccggggtccctgaccgattcgagtggcagcgggtntcgggacagatttcactctcnccatcagcagcctgcagctagaagagtgtggctagtttatactgtactaacgtagtttcgcgggggtcgttcggaccgtaacgggaccgaaggtaggaaataacgaaacgtacgtagtcggctgccttactacttcgttacgtcttcgttacttcccttcccgctaactccttaggaactaacgttaactcg

SEQ ID NO: 308191 - DNA, 649 bp, Homo sapiens
  misc_feature: GZ8MTXP01EZW6L.9.12.B01.1.454.CMB.2.raw
  modified_base (249)..(249): a, c, t, g, unknown or other
  misc_feature (249)..(249): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagtagttgtttanacggctccgaacaacaagaactacttagcttggtatcagacaagaaaccaggacacgcctacctaaactgacctactacttaacgtgggactacgtacccgtaaccccccggactaaacggtccccgggggtaccctacggtaaaccccgtatttccgaagggtcgggccgtacggggtccgggggttacgtaggggaacctaggtactttacactctaccacctatcagcagcctgacgagggctaggaagtagtggtacggtcttagttttataccttgtacgtaacgttcggtttttcgcggggtccgttacgggaccgaaacgggtaaccgtaagggttaaaggttaacttaacgtaaaaccggtagtcgggtagcgttacgaacttaacccgtaa

SEQ ID NO: 308192 - DNA, 646 bp, Homo sapiens
  misc_feature: GZ8MTXP01DMT7A.9.12.B01.1.454.CMB.2.raw
  modified_base (342)..(342): a, c, t, g, unknown or other
  misc_feature (342)..(342): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagactccctggctgtgtctcgtgggcgagacgggccaccatcaactgacaagtccagccagtagttgtttacacggctaccgaacaaacaagaactacttagcttaggtactcagacaaagaaaccaggacacgaccctacctaaactgactacaattaacgngggactacgtcccgtacccccggactaaacgtccccgggggtccctacggaacccgtattccgaagggttcgggacgtacgggtccggggtacgtaggggtacctagtactttaccaaccttctaccaaccatcaacgcacgtccctaggacgaggacgtaggaaagtgtgtggtacttagtttactacgtgtactaacgttcgtttcgtcgggtcgttcgggacgttaaaggggaaccgtaagggaaggttaaacttaaccgaaacggtacgtgggtacggacttacgccgttaaccgtaacg

SEQ ID NO: 308193 - DNA, 616 bp, Homo sapiens
  misc_feature: GZ8MTXP01EGH2X.9.12.B01.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggtttctgttgctatttaaaagtgtcagtgtgaggtgcagctggtggagtcgtgggggaggcttggtccgagccgtgggggtccctgaaactctcctgtgcagcctntggactacaccgtcagtacgtaactccatcgaacgtcggtccncgaggctaccgagggggaagggcgtaggaggtggtcctgtagtttatttagtagtcggtaggtaaaccactaatactacgcaacgaccgtccggtaggaaagggcaagtacttacaccattcccgacaaggaacaactaagttcccgaaaggactacgcttatactacttaacaaagttggaaacacggtccgtgaaacggtgtacccggaaggaaaccctggtccttaagttaatacgtttaacggngngaagagtagttacgttgttcgttacttgtttagaacgttcggtacggcggggtaacaaagggtc

SEQ ID NO: 308194 - DNA, 640 bp, Homo sapiens
  misc_feature: GZ8MTXP01CILEJ.9.12.B01.1.454.CMB.2.raw
  modified_base (439)..(439): a, c, t, g, unknown or other
  misc_feature (439)..(439): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggctccgaggggaagggcgtgggaggtgggtctacgtagtttattagtagcggtacgtaacacatactacgacagctccgtagaagggcagacttcaccatctaccgaagacgactaattccgaaggaacncgactgtaactctacaaagtgaaacacgaccgtagaagagtaccgaagggaaccacgggtaccttaggttaaattaacgtttaaacgtttgggtacggacggtaaaggtaggaaagtttcgggttaaggtttaacccggtttacgttttttaaggaaacttaaggttccggtaacggggggttaacccgtaaaaacggggg

SEQ ID NO: 308195 - DNA, 625 bp, Homo sapiens
  misc_feature: GZ8MTXP01BVYZ1.9.12.B01.1.454.CMB.2.raw
  modified_base (305)..(305): a, c, t, g, unknown or other
  misc_feature (305)..(305): n is a, c, g, or t
  modified_base (496)..(496): a, c, t, g, unknown or other
  misc_feature (496)..(496): n is a, c, g, or t
  modified_base (567)..(567): a, c, t, g, unknown or other
  misc_feature (567)..(567): n is a, c, g, or t
  modified_base (580)..(580): a, c, t, g, unknown or other
  misc_feature (580)..(580): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtcagtgtgaggtgcagctggtggagtcgtgggggaggcgttggtccagccgtgggggtccctgaaactctcctgtgcacgcctcgtggactacaccgtcagtagtaactccatgaacgtggtccncgaggctccgagggagggcgtggagtgggtctcgtagttatttacgtaggcggtaggtaaaccactataactacgacgaaacgactccggtaggaaacgggtcaggtacttaccacactcctaccgaagaacgaactaacttaccgaaaggaacaaccggtcttagtaactcttaacaaagttcgaaaacngtacccgtagaaacgtggtaacgagggtaaaccacggtcttaggtaacttagttaactggttagcgaaggngtaacgttggttnttacgtgtttagcttagccggttaggggtaacccaaggggtaacc

SEQ ID NO: 308196 - DNA, 546 bp, Homo sapiens
  misc_feature: GZ8MTXP01B75TU.9.12.B01.1.454.CMB.2.raw
  modified_base (485)..(485): a, c, t, g, unknown or other
  misc_feature (485)..(485): n is a, c, g, or t
  modified_base (522)..(522): a, c, t, g, unknown or other
  misc_feature (522)..(522): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggctccgaggggaaggggctgggagtgggtctcgagtttatttagtagcggtggtaacacatactacgacagaactccgtgaaggggcagattcaccatctccagacgacaattaccaggaacacgctgtatcttacaaatgaacagcctgagagtcggaagctacgggctgtaatnttacttgtgcgagagagttggttgtaacgtcttttgnttagttcgtggggccgtaaagggg

SEQ ID NO: 308197 - DNA, 564 bp, Homo sapiens
  misc_feature: GZ8MTXP01E2PO2.9.12.B01.1.454.CMB.2.raw
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
  modified_base (523)..(523): a, c, t, g, unknown or other
  misc_feature (523)..(523): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggttttccttgttgctatttaaaggtgtcagtgtgaggtgcagctggtggagtcgtgggggaggcttggtccagccgtgggggtccctgaaactctcctgtgcagcctctggatacaccgtcagtagtaactccatgaacgtgggtcccgccaggcgtccgagggggaagggggcgtgggaggtggggtctctagtttatttagtaggcggtagtaaccacatactacgcaagactccgtagaagggcagatcacatcacagagacaattccaaggaacacgctagtactacttacaaatcggaaacaggcctagagagccgaggacacggtntagtatatgtgngacgagagtattcggttgttacgttntttagaattacggtcgggttacggggaaccgaaggggtaac

SEQ ID NO: 308198 - DNA, 542 bp, Homo sapiens
  misc_feature: GZ8MTXP01A7R7D.9.12.B01.1.454.CMB.2.raw
  modified_base (397)..(397): a, c, t, g, unknown or other
  misc_feature (397)..(397): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (511)..(511): a, c, t, g, unknown or other
  misc_feature (511)..(511): n is a, c, g, or t
tcagtgatacgtctcacgaccggtgctcgatttagtagtgtagattccgcggggagctctgggagaggagcccagcactgggattccgaggtgtttccattcattgatctgcactgaacacagaggactcgccatggagtttgggctgagctgggttttccttgttgctatttaaaaggtgtccagtgtgaggtgcagctggtggagtcgtgggggaggcttggtccagccgtgggggtccctgaaactctcctgtgcagcctctggatacaccgcagtagtaactccatgaactggtccgccaggctccgagggaaggggctggagtgggtctcagttattatagcggtacggtaacacatactacgacagctccgtagagggcagatcaccatcncagagacaattccaggacacgctgtatcttacgaaatcgaaacngcctgacgagtccggaggacaccggtntagtataattcgngtgcgagagttagttggttacgtaacgttntttaagatcgttcggtaacgggaacgtaagg

SEQ ID NO: 308199 - DNA, 601 bp, Homo sapiens
  misc_feature: GZ8MTXP01BNWL0.9.12.B01.1.454.CMB.2.raw
  modified_base (514)..(514): a, c, t, g, unknown or other
  misc_feature (514)..(514): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtggggggaggcttggtccagccgtggggggtccctgaaactctcctgtgcagcctctggatacaccgtcagtagtaactccatgaacgtgggtccgccaggctccgaggggaaggggctaggaggtgggtctcgtagtttatttagtagcggtaggtaacacatactacgacagcgtccgtagaagggcagactcaccatctaccagagacaattaccgaaggaacacgctagtaatcttacaaagtcgaaacacgcctaggaagtacgtcgaaggactacgggcttaggtaataacgttacgnggtacgacggaaagtggttaagttggttacggttaacgttcgtttttaagaacgttagttccggtaagggggaaccctaaaaggggg

SEQ ID NO: 308200 - DNA, 517 bp, Homo sapiens
  misc_feature: GZ8MTXP01B13PM.9.12.B01.1.454.CMB.2.raw
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (487)..(487): a, c, t, g, unknown or other
  misc_feature (487)..(487): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactgggcatctacccggcaagtccggggtccctgaccgattcagtggcaggcgggtctgggacagatttcactctcnccatcagcagcctgcaggctgaagntgtggactagtttatactgtcaatgttttcgcgggggtcgttcgggccaagggaccaaggtggaaatacaaacgtactgtggctgcaccattcgtgtcttcnttccttcccgctaatctgacgtcgttaatc

SEQ ID NO: 308201 - DNA, 600 bp, Homo sapiens
  misc_feature: GZ8MTXP01AHWBE.9.12.B01.1.454.CMB.2.raw
  modified_base (244)..(244): a, c, t, g, unknown or other
  misc_feature (244)..(244): n is a, c, g, or t
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtcttgggcgagagggccaccatcaactgcaagtccagccagagttgtttanacggctaccgacaacaagaactactagcttggtatcagacaagaaacccaggacacgcctacctaaactgctacattaacgtggacatccgtacccggccaacgtccgggggtccctcggacccgtaattcgngtggcgaggcgggtctggggacacgtatttccactctacaccatccagcacgcctgcagggtcaggggaaagntgggtacggtacttaaggttttattacgttagtacctaaacgttacgttttccggcgggtccgtttcgggaccggtaaacgggaccgtaaagggtacggaaacttacgaaaccgtaacgtgtaacggctacggactaaccgttaattccg

SEQ ID NO: 308202 - DNA, 577 bp, Homo sapiens
  misc_feature: GZ8MTXP01EAKJ5.9.12.B01.1.454.CMB.2.raw
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcaagaaaccaggacagcctactaaactgctcattaactggcatctacccggcaacgtccggggtcctgaccgatttcagtggcaggcggtctgggacagatttcactctcnccatcagcagcctgcaggctagaagtntggtgtacttagtttactacgtagtactaacgttacgtttcggcgggggtcgttacggaccggaaacgggacgaaaggtacgaaactaacgaaacgtacgtgtcgctcgacactacttcgttcgttaccttacttaccttacccgttcccgacctaacgtacgtaacgttaacgtaacgttaacgtaacg

SEQ ID NO: 308203 - DNA, 592 bp, Homo sapiens
  misc_feature: GZ8MTXP01DNUE8.9.12.B01.1.454.CMB.2.raw
  modified_base (244)..(244): a, c, t, g, unknown or other
  misc_feature (244)..(244): n is a, c, g, or t
  modified_base (330)..(330): a, c, t, g, unknown or other
  misc_feature (330)..(330): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgtttanacggctcgaacaacaagaactacttagcttggtatcagcaaagaaaccaggacacgaccctactaaaactgctacaatttaaacgngggacatccgtaacccccggctaaagtcccggggtaccctgaacccgtattcgaagtgggacaggcgggtctaggggactagtatttcactctacaccgatcagcagcctgcacggntagaanagtgtggctagtttataacctgtactaaactgtttcgaacgggtcgttacggaccgaaagggaacccgtaaggttaggttaaaacgttaaacaaacggtaaaacctcggttagggacttacggtccgaacccgttaacg

SEQ ID NO: 308204 - DNA, 631 bp, Homo sapiens
  misc_feature: GZ8MTXP01CMGOQ.9.12.B01.1.454.CMB.2.raw
  modified_base (425)..(425): a, c, t, g, unknown or other
  misc_feature (425)..(425): n is a, c, g, or t
  modified_base (472)..(472): a, c, t, g, unknown or other
  misc_feature (472)..(472): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagcttgggttttccttgttgctattttaaaaggtgtccagtgtgaggtgcagctggtggagtcgtgggggaggcttggtccaggccgtgggggtccctgaactctcctgtgcagcctctggatacaccgtcagtagaactccatgaactgggtccgccgaggctccgaggggaagggcgtgggagtgggtctcgtagtttattagtagcggtaggtaacacgactactacgcaacgaccgtcccggtagaacgggcaagacttacgaccaatctaccagganaaacaattaccgaaggtaacacgtctagtactcttacaaatgaaacnggcctggagacgtacggaacggcaacgggtctaggtattacgttactgggtaacgcggaaggtagagttcgggtacgttaaccggttctttttagggaacttacgttccgggtaaggggggtaccccgaaaagggggtaaccttaaacgggtttccggg

SEQ ID NO: 308205 - DNA, 576 bp, Homo sapiens
  misc_feature: GZ8MTXP01BDAAE.9.12.B01.1.454.CMB.2.raw
  modified_base (251)..(251): a, c, t, g, unknown or other
  misc_feature (251)..(251): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagagggccacatcaactgacaagtcccagccaggtagttgtttanacggctccgaacaacaagaactacttagcttggtatcagacaagaaaccaggacacgccctactaaactgctactattaacgtggacatccgtacccccggacaacgtcccggggtccctgaacccgtattcgagtcggcgaggcgggtctagggactagtattcactctcacatcagcacgcctgacgaggctaggaagatggtcgatagtttataccgtgtacctaattcgtttcgcgggtaccgttcggaccgttaaacgggaaccgtaaggttacggaaattaccgaaagtaacgtggtcgacttacggcttaacccgtaa

SEQ ID NO: 308206 - DNA, 560 bp, Homo sapiens
  misc_feature: GZ8MTXP01CTED4.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctactaaactgctacataactgggcatcctaccccggcaactccgggggtccctgaccgatttcgagtggcaggcgggtctcgggacagatttcactctcaaccatcagcagcctgcaggctgaagatggtggctagtttatactgtactaacgtagttttcgtcgggggtcgttacgggaccgaaaggggacctaaagggtagaaacgtacgaaacgtaacgtcgtaggctaacgcactacgttcttagtcttacgcttcctccccgctaatcgtggaacgtcgttaacgtaacg

SEQ ID NO: 308207 - DNA, 572 bp, Homo sapiens
  misc_feature: GZ8MTXP01AQ0LO.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactggtccgccaggctccgaggggaaggggcgtgggaggtggggtctcgtagtttatttagtaggcggtggtaaccacatacgtacgcaacgactccgtagaaagggcagattcacatctcagagacaattccaaggaacacgctagtatcttacaaatgggaaacagcctaggaagacgtcgaggaccacggtctagtaatagttaactggttgacggagtagattggttgttacgtcttttagaagttagtcggttaggggaacccgaaggggtaac

SEQ ID NO: 308208 - DNA, 620 bp, Homo sapiens
  misc_feature: GZ8MTXP01AZNO5.9.12.B01.1.454.CMB.2.raw
  modified_base (212)..(212): a, c, t, g, unknown or other
  misc_feature (212)..(212): n is a, c, g, or t
  modified_base (409)..(409): a, c, t, g, unknown or other
  misc_feature (409)..(409): n is a, c, g, or t
  modified_base (614)..(614): a, c, t, g, unknown or other
  misc_feature (614)..(614): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattgggagagggccacatcaactgcaagtccagccagagttgttttanacggctaccgaacaacaagaactacttagcttggtatcagcaagaaaccaggacacgcctactaaactgctacaattaactgggcactacctaccccggcaacgtcccggggtaccctggaccgattcgagtggcaggtcggtctagggacagtattccactctaccaaccatccagcacgcctgcagctagaaagntgtacggattaggtttatacgtgtactaacgttacgtttcggccggggggtacgttacggaaccgggaacggtaaacggaaacggtagtaaacgtaaccgtaaacgtaacggtacgtgggccttaacggaccacctaacgttcgttacgttccttacttacttccccttaacccgaccttaatccgtagggaaactaacgttaanaaccgg

SEQ ID NO: 308209 - DNA, 621 bp, Homo sapiens
  misc_feature: GZ8MTXP01EIV1Q.9.12.B01.1.454.CMB.2.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
  modified_base (419)..(419): a, c, t, g, unknown or other
  misc_feature (419)..(419): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgacattgggtnctttaanaactatcgtctcctggtaccaanagcaccaggacaaacgtccccaaatcatagaatttangaggtcaaataagcggaccctcgtgggtcctgactcgcttctcctggctcaagtctaggacaacgcggccctccctgaccctctctgggcctcgaggctgacgagtgacgtntgtattatactgcaggctcaattacgcgacgaacggccaaacccctataaacgttcgttaccgtttacgggaaacggttccggggaaccctaaccggggtttccaaccccgtttaccgttacggggttaccaaccggaacccccgtaaacgggaaccccaaaacccccgggtcgttacgtcccgttaaacccttttccccgg

SEQ ID NO: 308210 - DNA, 833 bp, Homo sapiens
  misc_feature: GZ8MTXP01EUGW2.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccaccatcaactgacaagtccagccagtagttgtttacacggctaccgaacaaacaagaactacttagcttaggactcagacaaagaaaccaggacacgacctacctaaactgacctactaattaacgtcgggactacgtaccgtaaccccccggactaaccggtcccgggggtacccctacggtaaaccccgtatttccggacgggtcggggaccgtacggggtccgggggtttacgacgggggtaaacctaggttaaccttttccaaccgttcccttaacccaaaccctaacgttaccgaaacggtccaaacggccccgttagggaaccgaaccggggtaccggttaaacgggaaaaggttaacggtttggggttaacggggttaccttttaaaggttttttaaactttaacccggttaggttaaacccgttaaaccggtttacgggtttttttccgggcccggggggtttacccggtttacccgggggaaacccggttaaaccgggggtaaacccggtaaaaggggttaaacgggttaaaaccgttaaaaccgtaaaacgggtaaaccgttcgggttacgggaccgttaaccggaacccttaacccggttaaccg

SEQ ID NO: 308211 - DNA, 569 bp, Homo sapiens
  misc_feature: GZ8MTXP01EZNXA.9.12.B01.1.454.CMB.2.raw
  modified_base (248)..(248): a, c, t, g, unknown or other
  misc_feature (248)..(248): n is a, c, g, or t
  modified_base (419)..(419): a, c, t, g, unknown or other
  misc_feature (419)..(419): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactccctggctgtgtctctgggcgagagggccaccatcaactgcaagtccagccagtagttgttttanacggctccgaacaacaagaactacttagcttaggtatcagcaagaaaccaggacagcctactaaactgctactaattaacgtgggacactcctaccccccggctaacgtcccggggtccctgaacccgtattcgagtgcagggcgggttcgagggacagtacttcgactcncacatccgagcacgcctgacgaggctagaaagnttggnggtcctagtttactacctgtactaaacgtcggttttcgcgggtcgttaccggcgaaacgggaccgaaggttacgaaattacgaaagacttggcggcttgccttaacgtaacg

SEQ ID NO: 308212 - DNA, 591 bp, Homo sapiens
  misc_feature: GZ8MTXP01C04K3.9.12.B01.1.454.CMB.2.raw
  modified_base (248)..(248): a, c, t, g, unknown or other
  misc_feature (248)..(248): n is a, c, g, or t
  modified_base (332)..(332): a, c, t, g, unknown or other
  misc_feature (332)..(332): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgtttanacggctaccgaacaaacaagaactacttagcttggtatcagcaagaaaccaggacacgccctactaaactgctacaattaacgnggactactaccgtaccccccggactaacgtcccgggggtaccctacggaacccgtattcgagggtcggctagggcgggtctggggactagtatttcactctacaccatcagcacgcctgcaggctagaagtatggtcgtcttagtttactactgtactaacgttcgttttcgcgggtcgttacgggaccgaaagggtaaccgaaggttacggaaacttaccgaaacgtaacgtgggtcgtcgacgtaaccaaccgtaag

SEQ ID NO: 308213 - DNA, 746 bp, Homo sapiens
  misc_feature: GZ8MTXP01DLPRB.9.12.B01.1.454.CMB.2.raw
  modified_base (573)..(573): a, c, t, g, unknown or other
  misc_feature (573)..(573): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctcccgtggctgtgtctcgtgggcgaggacgggccaccatacaactgacaagtccagccaagtagttagtttacacggctaccgaacaaacaaagtaactacttagcttaggtactacgaagacaaacgaaaaccgaggaacacgtaccccttaacctaaaactcgaccttactaaacgtttaaaccgtcgggacctaacttacccggtaaaccccccccggaccgtaaaaccgggttcccccgggggtacccctacggaaaaccccggttatttccggaaagggttcggggaccgtacggggtccggggtacggtacggggaacctaagttacttttaccaaccttcctaccaaccacttacgaagccaacgccctgaccgaacgggtntaaggaaagtagttgggtacggtactttaagttttaacgttactcgttaactaaacgttcggttttccggcggggttcgttacccgggaccgaaacgggtaaaccgaagggttaacgaaaacttaaccggaaaaccgtacgtgggttcggcgttacgaacccgaacgttaacg

SEQ ID NO: 308214 - DNA, 689 bp, Homo sapiens
  misc_feature: GZ8MTXP01AOFRB.9.12.B01.1.454.CMB.2.raw
  modified_base (251)..(251): a, c, t, g, unknown or other
  misc_feature (251)..(251): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctcctggctgtgtctcgtgggcgaggacggccacatcaactgacaacgtccagccagtagttgtttanacggctaccgaacaaacaagaactacttagcttggtatcagacaaacgaaacccaggaccacgtccctaacctaaactcgactactaagttaacgtcgggactacgtacccgtaccccccggactaacggttccccgggggtaccctacggtaaacccgtacgtttcgacgggtcgggaccgtacggggtccggggtacgtaggggaacctagttactttccactctaccactactacgacgtccacgtccctggaccgacgggtactaaggaagtgtacgggtaggttaccttaagttttacttaacgtcgtaacctaacgttcggttttccggaacgggttccgttacgggaaccgaaaggggaaccgtaagggttaacggaaacttaaccgaaaacggtacgttgggacggaccgttacgaacccttaacgttcg

SEQ ID NO: 308215 - DNA, 742 bp, Homo sapiens
  misc_feature: GZ8MTXP01CRSWE.9.12.B01.1.454.CMB.2.raw
  modified_base (248)..(248): a, c, t, g, unknown or other
  misc_feature (248)..(248): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccaccatcaactgcaagtccagccagagttgtttanacggctaccgacaacaagaactactagcttaggtatcagcaagaaaccaggacacgaccctacctaaactgacctacaattaaacgtgggacacgtcccgtaaccccccgggactaaacggttccccgggggtcccctaggaaaccccggtatttccgaagggttcgggacgtacggggccgggggttcgtacgggggaacctaggttaactttcccaaccttcctacccaaccctatacccgaaggccaacggcccctaggaccgaacgggtccgttaaggaaaaggttattggggtacgggtacctttaaaggtttttacttaacccgttggtaacccttaaacgtttcgggtttttcccggcgggggttcccggttttacgggaacccgggttaaacgggggaaacccggtaaggggttaaacggttaaaacgttaaccggaaaacggtaaaccgttggtacgggtcttacggaacccgttaacccttaag

SEQ ID NO: 308216 - DNA, 692 bp, Homo sapiens
  misc_feature: GZ8MTXP01AE5T0.9.12.B01.1.454.CMB.2.raw
  modified_base (247)..(247): a, c, t, g, unknown or other
  misc_feature (247)..(247): n is a, c, g, or t
  modified_base (327)..(327): a, c, t, g, unknown or other
  misc_feature (327)..(327): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttanacggctccgacaacaagaactacttagcttggtatcagcaagaaaccaggacagcctacctaaactgactcaattaacgngggacactccgtacccccggacaacggtcccgggggtccctaggaacccgtattccgagggtcgggcacgggtccggggttcgacgggggaacctagtactttccaaccttcctaccaccctaatccgaaggcccaaggcccctggaccgaggtaccgtaggaaagtgttgggttcgggtaccttaggttttaactttacgtacggttacctaaacggtttcgttttccggtcggggtcgtttaccggggacccggttaaaacgggggtaacccggtaaaggggttaacgggttaaaacgttaacccggaaaaaccggtaacggttcgggtacggtacggttacggaacccgttaaccttaaccg

SEQ ID NO: 308217 - DNA, 731 bp, Homo sapiens
  misc_feature: GZ8MTXP01DPJ5I.9.12.B01.1.454.CMB.2.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtagttgtttanacggctaccgaanaaacaaagtaactacttagcttggatcagcaaagtaaaccgngacacgaccctaactaaactgctacattaaacgnggacatcccgtaacccccggacaaacgtcccggggtccctaggaaacccgtattccggaagtcggccgacgggtccgggtcgtacggggacagttactttcaaccttctaccaacccatacgaacgtccgaagtcccgtagccgaagggtactttaagggaaaggttaccttggggtcggtaacctttaaaggtttttaacttaaccgtcggtttaaccctaaaaccggttttggtttttccccgggtcggggttccccggtttaacgggaaaccccggttaaaacgggggtaaacccgttaaaagggggtttaaacggaaaaccgtttaaaccgaaaaacccggtaaagttcgggttacggggaccttacggtaacccttaaccccggttaag

SEQ ID NO: 308218 - DNA, 555 bp, Homo sapiens
  misc_feature: GZ8MTXP01BGJ80.9.12.B01.1.454.CMB.2.raw
  modified_base (244)..(244): a, c, t, g, unknown or other
  misc_feature (244)..(244): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccaggacagcctacctaaactgctcattaactgggcatcctacccccggcaacgtcccggggtccctgaacccgattcagtcggcaggcgggtctggggacagtatttcactctcacatcagcacgcctgcaggcgtagaagagtcggtggctaagtttattaacgtgtacacttagtttctcggggtcgttcggaccgaaacggggaccaagggttaggaaacttacgaaacgaacgtaaggtcggcgttcgcgttaaccgtaac

SEQ ID NO: 308219 - DNA, 657 bp, Homo sapiens
  misc_feature: GZ8MTXP01CQGZJ.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggttttccttgttgcttaattttaaaaggtgtccagtgtgaggtgcagctgggtggagtcgtgggggaggtcgttggtccaggccgtggggggtccctagaaactctcctgtgcacgcctctggactacaccgtcagtagtaactccatgaacgtcgggtccgccaggccgtaccggaagggggaaggggcgtgggaggtgggtctacgtagtttattagtagtcggtaggtaaaccactaatacgtacgcaaacgtactccgtagaagggacagtactacacactcacaagagacaacgttaccaaggaacacgtcttagtactactacgaaatcggaaacaggcctaggaacgtacggtaccggaaggaaaccgcggtactagttaaatacgttaacgtaggttcggacgaaggtaagtagttacggttcggttacgtttaactttttaggaacgtttaacggtcgggttaacgggggaaaccgttaaagggggttaacccg

SEQ ID NO: 308220 - DNA, 579 bp, Homo sapiens
  misc_feature: GZ8MTXP01CFE75.9.12.B01.1.454.CMB.2.raw
  modified_base (304)..(304): a, c, t, g, unknown or other
  misc_feature (304)..(304): n is a, c, g, or t
  modified_base (504)..(504): a, c, t, g, unknown or other
  misc_feature (504)..(504): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccaggccgtggggggtccctgaaactctcctgtgcagcctctggatacaccgtcagtagtaactccatgaactgggtccncaggctccgaggggaaggggctgggagtggggtctcgtagtttatttagtaggcggtaggtaaacccacatactacgcaagacctccggtgaaagggcagattcacatctccagagacaattccaaggtaacacgtctagtatcttacaaattgggaaactagcctagaagtagcggaaggacacgggtctaggtaactnttaactgttggcgaggtagagttgttcgttacgtgttttagaattagtcggttaggggaaccaaagggggtaacc

SEQ ID NO: 308221 - DNA, 550 bp, Homo sapiens
  misc_feature: GZ8MTXP01CK12C.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagagttgtttancggctccgacaacaagaactacttagcttggtatcagcagaaaccaggacagccctacctaaactgctacattaactggacatcctacccccggacaacgtcccggggtcctgaaacccgattcgagtggcaggcgggtctgggacagtattcgactcctcacatcagcagcctgccaggcgtgaagtatgtggctagtttattactgtactaagtcgtttcgccgggtcgttcggaccgaagggtaccgtaagggttacggaaagttccgaaaacgacgtaagtcggtcgactccgaactaacg

SEQ ID NO: 308222 - DNA, 593 bp, Homo sapiens
  misc_feature: GZ8MTXP01D975K.9.12.B01.1.454.CMB.2.raw
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagaggccaccatcaactgcaagtccagccagagttgttttatacggctaccgacaaacaagaactacttagcttggtatcagacaagaaaccaggacacgcctactaaactgctacattaacgtgggcactccgtacccggctaacgtcccgggggtccctgaccgtatttcgaggtggcaggcgggtctacggggactagtatttccactcctacaaccatcgancagcctgcagcgtagaaagnttggaggtacttagttttatactgtactaacgttagttttccgcggggggtacgttacggaccgaaagggaccgaaaggtacgaaatacgaaacgtactgtcggctcgacactacttcgtcttcttacgttcttaccccgttcccgactaacttcgagttaactaaccgttaactcgg

SEQ ID NO: 308223 - DNA, 567 bp, Homo sapiens
  misc_feature: GZ8MTXP01DGUMS.9.12.B01.1.454.CMB.2.raw
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
tcagtgatacgtctcacgaccggtgctcgatttagtagtgtagattccgcgggattgtgaagtgagctacaacaggcagggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttatacggctccgaacaacaagaactacttagcttggtatcagcaagaaacccaggacacgacctacctaactgcctcattaactgggcatcctacccccggcatccggggtccngaaccattcagtgcagcgggtctgggacagntttcactctcacatccagcacgcctgacgaggctaggaaagattggtaggcctaggtttttataaccgttgtactaacttggttttcgtcggggtcgtttccgggaccgttaagggaacccgaaaggttagggaaacttagaaaaccgggtaactggtcggacttcgtcgaacccgtaag

SEQ ID NO: 308224 - DNA, 762 bp, Homo sapiens
  misc_feature: GZ8MTXP01D830L.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgttacggggacatcgtgatgacccagtctccagacctccctggctgtgtctcgtgggcgagcgggccaccatcaactgacaagtccagccagtacgttgtttacgacggctaccgaacaaacaagaactacttagcttggatcagcaaacgaaacccgaggtacacgaccctactaaacgtgaccttactaagtttaacgcgggactaacgtacccgtaaccccccgggactaaacggttccccgggggtcccctaggaaaccccgtaatttccgaaagggttcggaccgtagggttcggggtaccgtaggggaacctaggtacttttaccaactccttacccaacctaacgttccgaagaccgaacgtcccgtggaaccgacggggtaccttaaggaaagttgttcggtagggtaacctttaaggtttttaataaacgttcggttaacctaaacccggttttggtttttacccggggcggggttcccggtttaccgggaaacccggttaaacgggggaaacccggtaaaggggttaaacggttaaacttaaacccggaaaaccgggttaacgttgggtccgggtacttaccggaacccgttaacccgtttaag

SEQ ID NO: 308225 - DNA, 553 bp, Homo sapiens
  misc_feature: GZ8MTXP01BG0Y0.9.12.B01.1.454.CMB.2.raw
  modified_base (272)..(272): a, c, t, g, unknown or other
  misc_feature (272)..(272): n is a, c, g, or t
  modified_base (407)..(407): a, c, t, g, unknown or other
  misc_feature (407)..(407): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctctggatacaccgtnagtagaactccatgaactgggtccgccaggctccgaggggaaggggctggagtgggtctcgagtttatttagtagcggtggtaacacgactactacgcagactccgtgaagggcagacttcaccatctcccaganacaattccgaaggaacacgcttgtactcttacaaatgaacacgggcctagagagtcgaggacacggctggtaatattacgnggtgngagagagtgtgttacgttnttttggaattntcgtggggaccttaaggggcttaaggtcgg

SEQ ID NO: 308226 - DNA, 585 bp, Homo sapiens
  misc_feature: GZ8MTXP01CEZJT.9.12.B01.1.454.CMB.2.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (324)..(324): a, c, t, g, unknown or other
  misc_feature (324)..(324): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcaggagggccaccatcaactgacaagtccagccagtagttgtttanacggctaccgaanaaacaagaactacttagcttggtatcagcaaagaaaccaggacagccctactaaactgacttnaattaacgtggactaatccgtacccccggactaacgtcccgggggtcccnggaaacccgtattcgagtcggcaggcgggtcngggaacagtacttcactctcacatcagcacgcctgcaggctaggaaagtgtgtggcttagtttacgttacctggtacctaaacttcgttttcgccggggtcgttacgggacccgaaagggtaccgaaggttaacgggaattacgaaacgggactggacgcgttacgaaccgaactaacg

SEQ ID NO: 308227 - DNA, 545 bp, Homo sapiens
  misc_feature: GZ8MTXP01CMF85.9.12.B01.1.454.CMB.2.raw
  modified_base (440)..(440): a, c, t, g, unknown or other
  misc_feature (440)..(440): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccaggccgtggggggtccctgaaactctcctgtgcagcctctggatacaccgtcagtagtaactccatgaactgggtccgccaggctccgaggggaagggggctggaggtgggtctcgagttatttataggcggtaggtaaccacatactacgcaagactccgtagaagggcagattcacatctcagagacaactccgaagtaacacgctgtactntacaaatgaacagcctgagagtcgagacgacgtctgtactgttaactggttgcgagagacttgttgttacgtntttgaattgtcgnggggtaaccaaggggtaac

SEQ ID NO: 308228 - DNA, 737 bp, Homo sapiens
  misc_feature: GZ8MTXP01BN99U.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcgttggtccgagccgtgggggtccctgaaactctcctgtgcacgcctctggatacgaccgtcagtagtaacctccatagaacgtcgggtccgccgaggccgtaccgagggggaaggggcgtgggaggtgggtctacgtagtttatttagtaggtcggtaggtaaacccacaataccgtacgacgaaacgtacctcccggtaggaaacggggccaagtactttaccgaacctaacgttcccacccgaaagggtaacaaacctaaacgttacccgaaaggggaaaccctacgggtccttaggttaacttacctttaaacgaaaacgttacgggaaaccacggtaccccgtagggaaacgggtacggttacccgggaaaggtaaaccccgaggggttccttaaaggttattaaacgtttaaccgtgggttacggacggttaaggacgttaagttgggttacgttaccgtttgtttagaacgttacgtccggggttacgggggaacccaaagggggttaacc

SEQ ID NO: 308229 - DNA, 550 bp, Homo sapiens
  misc_feature: GZ8MTXP01EOQJP.9.12.B01.1.454.CMB.2.raw
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (528)..(528): a, c, t, g, unknown or other
  misc_feature (528)..(528): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactggtccgccaggctccgaggggagggctggaggtggtctctagttatttagtagcggtaggtaaccactatactacgcaacgactccgtagaagggcagattcacatcncaganacaatcaaggacncgctgatcttacaaatggaacngcctagagngtcgaggacacggtctagtatattaactgttcgcgagaggtattggttgttaccgtgttttgaacttagtcggngggggtaaccaagggggtaacc

SEQ ID NO: 308230 - DNA, 657 bp, Homo sapiens
  misc_feature: GZ8MTXP01AS7VK.9.12.B01.1.454.CMB.2.raw
  modified_base (383)..(383): a, c, t, g, unknown or other
  misc_feature (383)..(383): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcttgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatcgaacgtcgggtccgccagggcctaccgagggggaagggggcgtgggagtgggtctacgtagtttatttagaggtcggtacggtaacanactactacgacacgaactcggtagaagggcagtactacaccatctaccgagacgaacaacttacccgaaggaaacctacggacttagtaacttacgtttaacaaattacggaaactacggacccgttaggaacggacggttacgggaaacggaccgaaccggggtcttaagttaacgttaacgtttaacgttggtacggacgaaaggtacgaggttggttacggttaacgttcgttttgacttaggttccggttaaggggaacccggtaaaggg

SEQ ID NO: 308231 - DNA, 714 bp, Homo sapiens
  misc_feature: GZ8MTXP01DIKAQ.9.12.B01.1.454.CMB.2.raw
  modified_base (249)..(249): a, c, t, g, unknown or other
  misc_feature (249)..(249): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcattttctctgttgctctggatctctggtgcctacgggacatcgtgatgaccagtctccagactccctggctgtgtctcgtgggcgagacgggccaccatcaactgacaagtccagccaagtagttgtttanacggctaccgaacaacaagaactacttagcttaggtatcgagacaaagaaaccgaggacacgtaccctactaaactgaccttacaacttaacgtggacctacttaccccgtaccccccggactaaaccggttccccgggggtaccctaggaaaccccgttagtttcgaagggttcgggaccgacggggtccggggttcgtaggggaactagttactttaccgacttccaccaccaacttccgaacggtccaacgcccgtaggacccgtaggggtacctaagggtaaacgtagttcgggtacgtacgtttaacgtttttaacgttaaccgtcgttaaaccgttaacgtttcggttttccggtaacggggttccgttacgggacccgttaaagggaaaccgtagggttaacggttaaacttaacggtaaacgtaagtcgggttacggcttacgaaccttaaccgttg

SEQ ID NO: 308232 - DNA, 645 bp, Homo sapiens
  misc_feature: GZ8MTXP01CF9IP.9.12.B01.1.454.CMB.2.raw
  modified_base (584)..(584): a, c, t, g, unknown or other
  misc_feature (584)..(584): n is a, c, g, or t
  modified_base (608)..(608): a, c, t, g, unknown or other
  misc_feature (608)..(608): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagtcttgggttttccttgttgtcttaattttaaaaggtgtccagtgtgaggtgcagcgtgggtggaggtcggtgggggaggtcgttgggtccgaggccggtcggggggtccctaggtaaacctctcctgtgcacgcctcgtggactacaccgtcagtacgtaactcatcgaacgtcgggtccgaccgacggccgtaccggagggggaaggggtcgtgggtaggtcgggtctacgtagtttatttagtacggtcggtaggtaaccactatacgtacgacgaacgaccgtccgaggaaagggacagtacttaccacctatacctacaaggactaacctaacttaccgaaacggaaccacgtactagttactactaacaaactagaaacgtgccgtaagaagcgtacggagaccgagtctagtatattaacgtgttaggngaagtagtagttgttggttacttntttagaattacgtcggttacggggaaccaagggtaac

SEQ ID NO: 308233 - DNA, 553 bp, Homo sapiens
  misc_feature: GZ8MTXP01A2ODR.9.12.B01.1.454.CMB.2.raw
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (458)..(458): a, c, t, g, unknown or other
  misc_feature (458)..(458): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
  modified_base (527)..(527): a, c, t, g, unknown or other
  misc_feature (527)..(527): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccagccgtggggggtccctgaaactctcctgtgcagcctctggatacaccgtcagtagtaactccatgaacgtgggtccgccaggctccgaggggaaggggctgggaggtgggtctcgtagtttatttagtaggcggtaggtaacanatactacgacagctccgtgaagggcagatcaccntcncagagacaattcccgaaggaacacgctagtactcttacaaagtgaaacngcctagacgagtcgaaggacacggtntagtataatgngtgngagagttgttgttacgtgttgtttaagntacggttcgggtaacgggaacgaagg

SEQ ID NO: 308234 - DNA, 555 bp, Homo sapiens
  misc_feature: GZ8MTXP01D5J7A.9.12.B01.1.454.CMB.2.raw
  modified_base (303)..(303): a, c, t, g, unknown or other
  misc_feature (303)..(303): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
  modified_base (516)..(516): a, c, t, g, unknown or other
  misc_feature (516)..(516): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctcgtggatacaccgtcagtagtaactccatgaactggtccncagctcgagggagggctggagtggtctcgtagtttattagtagcggtagtaaccactatacgtacgcaacgactcgtagaagggcagtactcactactcacagagactaagttccaaggaacacgctagtatctacaaatcgaaacagcctagagagtcgaaggacacggtntagtatattaactgngacgagagtattggttcgttacgttntttggaacttagtccggttaggggaacccgaagggtaac

SEQ ID NO: 308235 - DNA, 599 bp, Homo sapiens
  misc_feature: GZ8MTXP01EKMS0.9.12.B01.1.454.CMB.2.raw
  modified_base (251)..(251): a, c, t, g, unknown or other
  misc_feature (251)..(251): n is a, c, g, or t
  modified_base (429)..(429): a, c, t, g, unknown or other
  misc_feature (429)..(429): n is a, c, g, or t
  modified_base (461)..(461): a, c, t, g, unknown or other
  misc_feature (461)..(461): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatcgacccagtctccagacctccctggctgtgtctcgtgggcgaggacgggccaaccatcaactgcaagtccagccagagttgtttanacggctccgaacaaacaaagaactactagcttggtatcagcaaagaaaccaggacacgaccctacctaaactgacctactaatttaaacgcgggactacgtacccgtaaccccccggactaaacgtcccgggggtaccctggaaacccgtattccgaggtcgggcagggtcggggtcnggggactagtactttccgactccacacatcancagcctgacaggcagaagtatggtcgtactaagtttataacctgtacaacgttcgtttcgcgggtcttcggaccgttaaagggaccgaaggttaagaacttacgaaacgtacgtggtacgcgttacgccgaactaacg

SEQ ID NO: 308236 - DNA, 542 bp, Homo sapiens
  misc_feature: GZ8MTXP01C692X.9.12.B01.1.454.CMB.2.raw
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaaggggcgtggagtgggtctcagtttatttagtagcggtaggtaacacactactacgcagactcccgtgaagggcagacttcaccatctccagagacaatccaggaacacgctgtatcttacaaatagaacaggcctagagagtcgagacaggctgtattattctgtgcgagagttagtgttgttacgttcttttgaatagtcgtggggaccaagggtaacaagtcgg

SEQ ID NO: 308237 - DNA, 641 bp, Homo sapiens
  misc_feature: GZ8MTXP01CE54G.9.12.B01.1.454.CMB.2.raw
  modified_base (603)..(603): a, c, t, g, unknown or other
  misc_feature (603)..(603): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctgggtggagtcgtgggggaggcttggtccaggccgtggggggtccctagaaactctcctgtgcagcctctggatacaccgtcagtagtaactccatcggaacgtcgggtccgccaggccgtccggaggggaagggggcgtgggaggtgggtctcgtagtttatttagtaggtcggtaggtaaacccactatactacgacaacgaccgtccgtaggaacgggtcagacttccaaccattccctaccgagaagtaaccaaattcccgaaacggtaaccacgtccttagtacttccttaaacaaatcgggaaacaggaccctagggaaggtacgtacggaagggaaccacggggtcttaggtaattacgtttaagtgttggacggagagtattcggttgttccgttntttagaattagtcggttacggggaaccgaagggtaacg

SEQ ID NO: 308238 - DNA, 594 bp, Homo sapiens
  misc_feature: GZ8MTXP01CS8AC.9.12.B01.1.454.CMB.2.raw
  modified_base (262)..(262): a, c, t, g, unknown or other
  misc_feature (262)..(262): n is a, c, g, or t
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
  modified_base (551)..(551): a, c, t, g, unknown or other
  misc_feature (551)..(551): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggtttctgttgctatttaaaggtgtcagtgtgaggtgcagctggtggagtcgtgggggaggtcgttggtccaggccgtggggggtccctgaaactctcctgtgcagcctntggactacaccgtcagtagtaactcatgaacgtcgggtccgccgaggcgtccggaggggaacgggggctagggaggtgggtctacgtagtttatttagacggtcggtagtaacccactatacgtacgcaagacctccgtagaagggcagtatcacatctacgagacgaacactcgaagtaccacgtctagttaactcttaaacaatacgggaacacgtctagaagtcgtacggagacgacggttntagttatataagnggttagaggagtagtgttgttcgttacgttnttaggaacgttacggcgggttacggggtaaccgaagggtaacg

SEQ ID NO: 308239 - DNA, 624 bp, Homo sapiens
  misc_feature: GZ8MTXP01EALNA.9.12.B01.1.454.CMB.2.raw
  modified_base (375)..(375): a, c, t, g, unknown or other
  misc_feature (375)..(375): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagtagtgttttatacggctccgacaaacaagaactacttagcttggtatcagcaagaaaccaggacagcctactaactgctacaattaactggcactccgtacccggctaacgtcccggggtccctgaccgtatttcgagttggcaggcgggtcgtgggacagtatttcactctcncctatcaagcacgccgtgcgacggactaggaaagtgttggtgggtactttaagttttacttaacgttgtactaacgttacggttttccggtacggggggtccggttacgggaaccgtaaacggggaaccgtaaagggtacgtaaacgtaacgaaacgtaacgttagggtggctcgcttaccgtacgttctacgttctttacgttcttaccctcccgtactaactcgtagaacggtaaccgttaatcccg

SEQ ID NO: 308240 - DNA, 659 bp, Homo sapiens
  misc_feature: GZ8MTXP01AF75X.9.12.B01.1.454.CMB.2.raw
  modified_base (247)..(247): a, c, t, g, unknown or other
  misc_feature (247)..(247): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatcgacccagtctccagactccctggctgtgtctcgtgggcgagagggccacatcaactgcaagtccagccagtagttgtttanacggctaccgacaaacaagaactacttagcttaggtatcagcaagaaaccaggacagcctactaaactgctactaattaacgtgggacactccgtaccccccggactaacggtccccgggggtcccctaggaacccgtattccgaggtcgggcgacgggtcggggtcgtaggggactagtactttaccacttcctaccaaccatccgacgaccacgccgtgaccgtaaggcgtaggaaagtagttggtcgtacttaaggtttacttaaccgtcgtacctaaacgtttcggtttttccggcggggtccgtttacgggacccgaaaggggtaaacccgtaaagggttacgggaaaacttaccgtaaaaccggtacgtcgggttacgggaccttacgaacccgttaaccgtaacg

SEQ ID NO: 308241 - DNA, 638 bp, Homo sapiens
  misc_feature: GZ8MTXP01D8WXE.9.12.B01.1.454.CMB.2.raw
  modified_base (303)..(303): a, c, t, g, unknown or other
  misc_feature (303)..(303): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcacgcctctggatacaccgtcagtagtaactcatgaactcggtccncaggctccgaggggagggctggagtggtctcgtagttattagtagtggtagtaaccactatacgtacgcaagactccggtggaacggcagacttacactatcctacaagacgaacaattcccgaaaggacacgtctagtactacttacaaagttcggaaactacggacctaggaaggtacgtacggaacgggaacctacggggtacctttaggttaaaccttagtttaacgtcgggaggtaccgggaagtaaggtcgtttagggttggttacccgtttggtttttagaacgttacgttccggggttacgggggtaaccgaaagggggtttaaccc

SEQ ID NO: 308242 - DNA, 709 bp, Homo sapiens
  misc_feature: GZ8MTXP01AGDIK.9.12.B01.1.454.CMB.2.raw
  modified_base (633)..(633): a, c, t, g, unknown or other
  misc_feature (633)..(633): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggttttccttgttgcttatttaaaaggtgtccagtgtgaggtgcagctggtggagtcgtgggggagcgttggtccgagccgtgggggtccctagaaactctcctgtgcacgcctcgtggactaccgaccgtcagtacgtaactcctagtcgaacgtcgggtcccgccgaggccgtccgaagggggaacggggcgtgggaggtcgggtctacgttagtttagtttagacggtcggtaggtaaacccactagtaccgtacgacgaaacgtaccgtccggtaggaaacgggctaacggtacttaccaacctattcccaacgaagaacgtaacctaaacttccgaaacggtaaccacgtccgttaagtaacttaccgtttaaacaaaacgttcgggggaaaacctacgggtcccttaaagggaacgtacgggtaccggaaaggtaacccgtaccgggtatttaagttaacgtaagtttaacggnggttacggagttagtagtgttcgttacgtttacgttaattagaacgttcggtacgggacgggtaacgaagggtaac

SEQ ID NO: 308243 - DNA, 639 bp, Homo sapiens
  misc_feature: GZ8MTXP01B8Q16.9.12.B01.1.454.CMB.2.raw
  modified_base (599)..(599): a, c, t, g, unknown or other
  misc_feature (599)..(599): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtcagtgtgaggtgcagctggtggagtcgtgggggaggcttggtccagccgtgggggtccctgaaactctcctgtgcagcctctggactacaccgtcagtagtaactcatgaacgtcggtccgcgacggctccgaggggaacggggcgtggagtggggtctcgtagtttattagtaggcggtaggtaaccacatacgtacgcaacgactccggtagaacgggcaagtacttcacctatcctaccaagaacgaactaattacccgaaagggaaacctacgtaccttagtaacttacgtttaaacaaaacgttacggaaaacgtaggtaccccgttagggaccggaagtaccgggaaggaaccgcggtactagttactaatttaaccgtggttagcggagaagtgttggttgttaccgttntttagaattactcgggttagggaaccgttaaagggtaacc

SEQ ID NO: 308244 - DNA, 676 bp, Homo sapiens
  misc_feature: GZ8MTXP01D3DY4.9.12.B01.1.454.CMB.2.raw
  modified_base (267)..(267): a, c, t, g, unknown or other
  misc_feature (267)..(267): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgcttattttaaaaggtgtccagtgtgaggtgcagctggtggagtcgtggggggagcgttggtccagccgtgggggtccctgaactctcctgtgcagcctcnggataccaccgtcagtacgtaactccatgaacgtcgggtcccgccgaggctaccgaggggaacgggcgtgggagtgggtctacgtagtttatttagtaggtcggtacggtaacactaagtacctacgacaacgccgtccggtagggaaacgggcaaggtacttacaacctactcgtaccgaagaacgaactaacgttaccgaacggaaccacgtaccttagttaacttactttaaaccaaaagttacgaaaccgtaacggtcccgtaggaacgacgggtacgggaaacggccgtaacgggtcttagttattaaagttcgttaggtcggacgaaaggtaggttagttggttacggtaacgtttctttaaggtaacttacgttcgggtaacgggttaacccgtaaaagggg

SEQ ID NO: 308245 - DNA, 661 bp, Homo sapiens
  misc_feature: GZ8MTXP01A4277.9.12.B01.1.454.CMB.2.raw
  modified_base (562)..(562): a, c, t, g, unknown or other
  misc_feature (562)..(562): n is a, c, g, or t
  modified_base (583)..(583): a, c, t, g, unknown or other
  misc_feature (583)..(583): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggttttccttgttgcttattttaaaaggtgtccagtgtgaggtgcagcgtggtggagtcgtgggggaggcttggtccaggccgtgggggtccctagaaactctcctgtgcacgcctgtggataccgaccgtcagtaacgtaactccatacgaacgtcgggtccgccgaggcctaccggagggggaacggggtcgtagggaggtcggggtaccttacgtaagtttacgtttaagtaggacggttaggtaaaccccactaagtaacccgtacgcaaacgtacctccggtaggaacgggcagtacttcaccaattccaccgaagacgaactaacttaccgaaggaacctacggtcttagttacttacttaacaaatcggggaaactagccgtagaacggagtcgaggaaccnggtactgttaactgttaacgngttggaacgttaggagtattaggttgttaacgttnttttanaacgtttacgcggttaggggaaccgttaaaagggtcc

SEQ ID NO: 308246 - DNA, 669 bp, Homo sapiens
  misc_feature: GZ8MTXP01DH8K8.9.12.B01.1.454.CMB.2.raw
  modified_base (591)..(591): a, c, t, g, unknown or other
  misc_feature (591)..(591): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtcctgaaactctcctgtgcagcctctggatacacgtcagtagtaactccatgaacgtggtccgccgaggcgtaccggagggggaagggcgtgggaggttgggtctcgtagtttatttagtaggtcggtacggtaaccacgtatacctacgaaccaagtaaccgtacccggtaggaaacggggacaacggtacttaccaaccctatacctaccgaagaacgaacctaaacgttaccgaaggtaaccacgcttagtaattacgttaacaaaagtcgaaacgtacgccgttagaacgtacggtaccggaaacgggtacctaacggggtacttaagggtaattaacgtttaacggnggtacgaggtaagtagttacgttggttacgttaacgtttagtttgaagttcgttaccgggtaacggggaaccgtaagg

SEQ ID NO: 308247 - DNA, 569 bp, Homo sapiens
  misc_feature: GZ8MTXP01CEX9X.9.12.B01.1.454.CMB.2.raw
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
  modified_base (519)..(519): a, c, t, g, unknown or other
  misc_feature (519)..(519): n is a, c, g, or t
  modified_base (538)..(538): a, c, t, g, unknown or other
  misc_feature (538)..(538): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctggtttccttgttgctatttaaaaggtgtcagtgtgaggtgcagctggtggagtcgtgggggaggcttggtccagccgtgggggtccctgaaactctcctgtgcagcctctggatacacgtcagtagtaactccatgaactcgggtccgccaggcctccgaggggaaggggctgggagtgggtctcgtagtttatttagtagcggtacggtaacacatactacgacagctccgtgaagggcagatcacatctacagacactaattccgaaggaacacgctagtaactcttaacaaaagttcggaaaccaggcctggaacgngtacggaaaggaccacgggtnttagtaataattcgnggtcgagaagnttagttgttagtaacgttnttaagatagttcggtaacggggaactaaggg

SEQ ID NO: 308248 - DNA, 778 bp, Homo sapiens
  misc_feature: GZ8MTXP01EHKRY.9.12.B01.1.454.CMB.2.raw
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaggtgtccagtgtgaggtgcagcgtggtggagtcgtgggggagtcttggtccagccgtgggggtccctgaactctcctgtgcagctctggatacacgtcaagtagtaactccgatgaactcgggtccaccaggcctaccggaagggggtaacgggggcttaggggacggttcgggggtacttcgtaagtttatttaagtaggtaccggtagggtaacactaagttacctaaccgtacgaacgtaaccgtacccggttagggaaacggggtcaaaggtaacgtttaccaaacccgttaattcccttacccgaaagggtaacgaaaccaaacgtttacccgaaacggggtaaaccacggtaccttacggtaattacctttaccgaaaaaggttcggaaaaccacggtacccgttagaaggacggtttaccggaaaggacccgtaccggggtacttaagggtttaactaaatttttaaacggggttaggtacggaaccggtaaaggttaaggttaccggttgggtttaaccggttaacgttttacggttttaacggtacgttaaccgggttaccggggtaaccgggggttaaacccggtaaacggg

SEQ ID NO: 308249 - DNA, 526 bp, Homo sapiens
  misc_feature: GZ8MTXP01A1UID.9.12.B01.1.454.CMB.2.raw
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctctaaactgctacataactgggcatcctaccccggcaactccggggtccctgaccgattcagtggcagcgggtctgggacngatttcactctcnccatcagcagcctgcaggctgaagatgtggctagtttatactgtactaacgtgttttcgcgggggtcgttccgggaccgaaggggaccaaggtaggaaactacaaacgtactggtacggctgcaccattctntcttncttcttcccgcntctgactcgttaatccg

SEQ ID NO: 308250 - DNA, 610 bp, Homo sapiens
  misc_feature: GZ8MTXP01BVIA7.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactcctggctgtgtctcgtgggcgagacggccacatcaactgcaagtccagccagtgttgtttanacggctccgaacaacaagaactacttagcttggtatcagcaagaaaccaggacacgcctacctaaactgaccttacaattaacgtgggcatccgtaacccccggctaacgtcccgggggtccctacggaaacccgagtttccgaggtacggcgacggtcgggtacgtgggacctagtatttccactctcaccgatcacgcagcctgacagggctaggaagtatgggtacgtctaaggttttacttacgtagtacctaacgtttacgtttttccggcggggtcgtttcgggaaccgttaacggggaaccgtaaggttaggaaacttacgaaaccgtagtaaggtcgcgttcgaaccgttcgtaacg

SEQ ID NO: 308251 - DNA, 776 bp, Homo sapiens
  misc_feature: GZ8MTXP01BIYKH.9.12.B01.1.454.CMB.2.raw
tcagtgatacgtctcacgaccggtgctcgatttagtagtgtagattccgcggggagctctgggagaggagcccagcactgggattccgaggtgtttccattcattgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaaccgtggtccgccaggcctccgagggggagggctgggagtgggtctcgtagtttatttagaggtacggtacggtaaacactagtaacctacgaccgaagtcccgtaccgggtagggaaacggggtcaaggtacttaccaaccctattaccctacccgaaggacgtaaaccctaaacgtttccccgaaaggggttaaacccaccggtaccttaggttaacttaccgtttaaacccaaaaaggtttcggaaaaaaccgtccggtaccccgttaagggaaaccgggtaacggttaccgggaaaccggggtaacccgtacccgggggttacttagggtttaaaccgttaattttaacccggttgggttacgggttaccggaaagggtaacggttaaacgtttgggttacggtttaacccgggttttacgttttaaggtaacgtttacgggttacccgggggtaacggggttaacccggtaaaggg

SEQ ID NO: 308252 - DNA, 817 bp, Homo sapiens
  misc_feature: GZ8MTXP01C4JG0.9.12.B01.1.454.CMB.2.raw
  modified_base (253)..(253): a, c, t, g, unknown or other
  misc_feature (253)..(253): n is a, c, g, or t
tcagtgatacgtctcacgaccggtgctcgatttagtagtgtagattccgcggggattgtgaagtgagctacaacaggcaggcagggggcagcaagatggtgttgcagacccaggtcttcatttctctgttgctctggatctctggtgccgtacggggacatcgtgatcgacccagtctccagactccctggctgtgtctcgtgggcgaggacgggccaccatcaactgacaagtccagccagtagttgtttanacggctaccgaacaacaaagtaactacttagtcttaggtactcagacaaacgaaaccgaggaccacgtaccccttaacctaaactcgaccttactaaagtttaaacgttcgggacctacgtaccccgtaacccccccggactaaaccggttcccgggggtacccctaggtaaaccccgtatttccgagggtcgggacccgtaagggtcccggggttacgtacgggggaaacctacggtttaacttttacccaaccttcctacccgaaacccctagtaccgaacgtaccgaccggtcccgttaggaccgtacggggtacttaaagggaaacggtacgttggggtacgggttaaccttttaaggtttttaactttaaccgtacggttaacccgttaaaacggttttcgggtttttcccgggtaaccgggggttacccgttaccgggggaaacccgggaaaacgggggtaaacccggaaggggtttaaaaacggaaacgttaaaacccgggaaaacgtaaacggttcggggtaacggtccgttacggaacccgttaacctttaaccg

SEQ ID NO: 308253 - DNA, 662 bp, Homo sapiens
  misc_feature: GZ8MTXP01AW2LG.9.12.B01.1.454.CMB.2.raw
  modified_base (243)..(243): a, c, t, g, unknown or other
  misc_feature (243)..(243): n is a, c, g, or t
  modified_base (474)..(474): a, c, t, g, unknown or other
  misc_feature (474)..(474): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctcctgcactggaaccagcagtgactagttggtntacttaataactatcgtctcctggtaccaacacgcaccaggacaaacgtccccaaatcatagtatttatgaggtacaaataacgcggtccctcgtcgggggtccctgactcgtcttctccgtcggctaccgtaagtccgtaacggaccaaccgaccgggtccctacccgtcgaccgttctcgtcgggccttcgagggtctgaacgtgtaggcgtctagtacttacttacgngacgcgtactacgtattacgcgaccgacggcccaaacctacgtaaacgttcgttaccggtaacgggtaacgggtaccgggttaacccgtaaaccggttccgtaaacccggttcgttaaccgggttcaacccggaaccccgaaccggaacccctaaaccccgtgttaccgtccttaacccggtttcccg

SEQ ID NO: 308254 - DNA, 648 bp, Homo sapiens
  misc_feature: GZ8MTXP01AF9XF.9.12.B01.1.454.CMB.2.raw
  modified_base (344)..(344): a, c, t, g, unknown or other
  misc_feature (344)..(344): n is a, c, g, or t
  modified_base (481)..(481): a, c, t, g, unknown or other
  misc_feature (481)..(481): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggcccaccatcaactgacaagtcccagccagtagttgtttacgacggctaccgacaacaagaactattagcttggtatcagcaaagaaaccaggacacgaccctacctaaactcgactactaagttaacgngggaccactcccgtaacccccggactaacggtcccgggggtccctaggaacccgtattccgagggtcggcgacgggccggggttcgaggggaacctagtactttcactctaccaccatcagcacgcctgcgtacggngtagaagtgtcggtacgtagttagtttacttacgtcgtaccgtaacgtttcggtttccggtccgggtaccggttaccgggaaccggaaacgggtaacggtaaagggttacgttaaacgttaaccgtaaacggtacgtcggtcggtacgttcgtaaccgttcgtaacg

SEQ ID NO: 308255 - DNA, 623 bp, Homo sapiens
  misc_feature: GZ8MTXP01EC4KO.9.12.B01.1.454.CMB.2.raw
  modified_base (305)..(305): a, c, t, g, unknown or other
  misc_feature (305)..(305): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccagccgtgggggtccctgaactctcctgtgcagcctctggatacgaccgtcagtagtaacctccatgaacgtgggtcccnccgaggcctccgaggggaaggggcgtggaggtgggtctcgtagtttatttagaggtcggtaggtaaacccacatacgtacgacaaacgacctccgggtagaaacggggacagtacttacacctatccctaccgaagacgaacaacgttaccaagggaaccacgtctagttactcttaacaaagtggaacctagtcctaggagtacgtacggaggaaccacgggtcttaggtaattagttaacgtgagtacgagagtattggttcgttaccgttgttttagaagttacgtcgggttcggggaaccgttaaggggtaacg

SEQ ID NO: 308256 - DNA, 700 bp, Homo sapiens
  misc_feature: GZ8MTXP01AY7PK.9.12.B01.1.454.CMB.2.raw
  modified_base (248)..(248): a, c, t, g, unknown or other
  misc_feature (248)..(248): n is a, c, g, or t
  modified_base (331)..(331): a, c, t, g, unknown or other
  misc_feature (331)..(331): n is a, c, g, or t
  modified_base (419)..(419): a, c, t, g, unknown or other
  misc_feature (419)..(419): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagtagttgtttanaccggctaccgacaacaagaactacttagcttggatcagcaagaaaccaggacagccctactaaactgctactaatttaacgngggcactccgtacccccccggctaaacgtccccgggggtccctacggaaacccgtattccgaggttcgggcgagggtcgggggttacngggggaacctaagttacttttccgaaccttctaccaaccctatccaaggcccagggtcccctggaccgaagggccttaggaaaggtgttagggtggtaccttaaggttttacttacccgtagttccaaaacgtttcggtttttcccggcgggggtcgtttacccgggggaacaaaccgggggaacccgtaaaaggggttaccgggaaaaacgttacccgaaaaacccgggtaacggttaaggttaacggggtccttacgggtaacccgaaccccgttaacg

SEQ ID NO: 308257 - DNA, 742 bp, Homo sapiens
  misc_feature: GZ8MTXP01CZB92.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgagtgcagctggtggagtcgtgggggaggcttggtcagccgtgggggtccctgaaactctctgtgcagcctctggactacaccgtcagtacgtaactccatcgaacgtcggtccgccgaggctccggaaggggaaggggcgtggaggtgggtcttcgtagtttatttagtaggtcggtacggtaaccactatactacgacaacgactccggtagaagggcagtacttacaccatcctacgaagaacgtaactaacttaccgaaggaaacctcgacgttataacttacctttaaacgaaaagttcggaaaaccgacggtacccgttaagggaaacggtaaccgggttaaccgggaaacggtaaacccggaccggttaccgtttaacggtttaaacttttaagggtttaacccgttagggttaccggtaacgggaaagggttaaacggttaacggttttagggtttcggtttaaacccgttttcgttttaagggtaacctttaggggttaccgggttaccggggggttaaaccccgaaaagggggtttaaacccg

SEQ ID NO: 308258 - DNA, 567 bp, Homo sapiens
  misc_feature: GZ8MTXP01C34E4.9.12.B01.1.454.CMB.2.raw
tcagtgatacgtctcacgaccggtgctcgatttagtagtgtagattccgcggggctctgggagaggagcccagcactgggattccgaggtgtttccattcagtgatctgcactgaacacagaggactcgccatggagtttgggctgagctgggttttccttgttgctattttaaaaggtgtcagtgtgaggtgcagctggtggagtctgggggaggcttggtccagcctgggggtccctgaaactctcctgtgcagcctctggatcaccgtcagtagtaactccatgaactgggtccgcaggctccgaggggaagggctggagtgggtctctagttatttatagcggtggtaaccacatactacgcaaagactccgtgaagggcagattcacatctccagacgacaattccaaggaacacgctagtactacttacaaagttggaaacaggtccctaggaacggagtcgaaggaccaacgggtcttaggtatagttaactgttagcggttagaggattggttgttacgttcttttgaattagtcgttagggggtaaccaaggggtaac

SEQ ID NO: 308259 - DNA, 615 bp, Homo sapiens
  misc_feature: GZ8MTXP01B1F0Y.9.12.B01.1.454.CMB.2.raw
  modified_base (400)..(400): a, c, t, g, unknown or other
  misc_feature (400)..(400): n is a, c, g, or t
  modified_base (466)..(466): a, c, t, g, unknown or other
  misc_feature (466)..(466): n is a, c, g, or t
  modified_base (554)..(554): a, c, t, g, unknown or other
  misc_feature (554)..(554): n is a, c, g, or t
  modified_base (571)..(571): a, c, t, g, unknown or other
  misc_feature (571)..(571): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgcttattttaaaggtgtcagtgtgaggtgcagcgtggtggagtcgtgggggaggcgttggtccgagccgtgggggtccctgaactctcctgtgcagcctcgtggactacaccgtacagtacgtaactccatcgtaacgtcgggtcccgccgacggctaccggagggggaagggcgtgggagtggtctcgtagttattagtaggtccggtaggtaacactactactaacgacncgacgtccggaggacggacagactcacctagtcctacgagacgaactaaacttccgaaggaaaccncgactagttacttaccttaaggaaattcggaaacacgtacctggacgaggtaccggaggtaaccacggtcttagtaataacgtttcgnggttcgacgtagagttnttgttaagtaccttgttttagattacggtcggttgggggaaccg

SEQ ID NO: 308260 - DNA, 588 bp, Homo sapiens
  misc_feature: GZ8MTXP01C60FP.9.12.B01.1.454.CMB.2.raw
  modified_base (303)..(303): a, c, t, g, unknown or other
  misc_feature (303)..(303): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggtttccttgttgctatttaaaaggtgtccagtgtgaggtgcagctggtggagtcgtgggggagcgttggtccagccgtgggggtccctgaactctcctgtgcagcctctggatacaccgtcagtacgtaactccatgaacgtgggtccncgaggctcgaggggaagggctgggagtgggtctcgtagtttattagtaggtcggtacggtaacactatacctacgaacgagtccgtcgtaggaagggcagtacttcacctatcaccagacgacaattcccgaaggaaccacgcttgtaacttctaacaaagtgaaccagtccctaaggagacgtcggaagaccgtacggtcttagtaattaagttcgttggtagcgtaaggagttagttgttacgtaagtcttttgatacgttcggtaacggggccgtaaagggg

SEQ ID NO: 308261 - DNA, 672 bp, Homo sapiens
  misc_feature: GZ8MTXP01A0BWK.9.12.B01.1.454.CMB.2.raw
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctatttaaaaggtgtcagtgtgaggtgcagctggtggagtcgtgggggaggcttggtccagccgtgggggtccctgaaactctcctgtgcagcctctggatacaccgtcagtagtaactccatcgaacgtcgggtcccgccgaggccgtccgagggggaagggcgtggaggtgggtctcgtagttattaagtggtaccggtaggtaacactatacgtaaaccgcaacgactcccggtaggaaggcagattcacctatctacagagactaaagttccaaggaaccacgtctagtaacttcgttaaccaaagttcggaaaccacgtccctaggaaagacggttaccgggaaggtaacccaacggggtacctttaggtaaatttacgtttaaacccggtggttacggtaacggaagttagggttaaaccgtttgggttaacggggttacctttaacggtttttggaaaacgtttgttaaccgggtttaacggggggtaaaacccgg

SEQ ID NO: 308262 - DNA, 735 bp, Homo sapiens
  misc_feature: GZ8MTXP01CVYDD.9.12.B01.1.454.CMB.2.raw
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagcttgggttttccttgttgcttattttaaaaggtgtccagtgtgaggtgcagctggtggagtcgtgggggaggcttggtccagccgtgggggtccctgaactctcctgtgcagcctctggataccaccgtcaagtacgtaactccatgaacgtcgggtccgccgaggctccggaggggaagggcgtggaggtgggtctacgtagtttattagtaggtcggtaggtaacactactacctacgcgacgaccgtacccggtaggaacgggcaaggtacttacacctactcctaccgaagaacgaactaaacgttacccgaaaggaaaccacggtcttacgttaacttaccttaacgaaaacttcgaaaccacggggtcccgttaaggaacgggtaacggttaccgggaaacgggtacccgtacggggtaccttaaggtttaacttaacgtttaaccgtgggttaacgaacggttaaaggtaaggttagtttacgggttacggttaacccgtttcgtttttagggaactttaacggttccggggtacgggggtaacccgttaaaagggggtaaccttaaacgggttttcccgggg

SEQ ID NO: 308263 - DNA, 583 bp, Homo sapiens
  misc_feature: GZ8MTXP01BSTRK.9.12.B01.1.454.CMB.2.raw
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (499)..(499): a, c, t, g, unknown or other
  misc_feature (499)..(499): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (548)..(548): a, c, t, g, unknown or other
  misc_feature (548)..(548): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcttgggttttccttgttgcttattttaaaaggtgtccagtgtgaggtgcagcgtgggtggagtcgtgggggaggcttggtccaggccgtggggggtccctgaaactctcctgtgcagcctctggactacaccgtcagtacgtaactccagtcgaacgtcgggtccgccgaggcctacgagggggaaggggcgtgggagtcgggtctacgtagtttattagtaggtcggtacggtaacacaacgtactacgacagccgtcgtaggaaggcanactcaccntcacaganacatacgagaacncgntgtatctacaagtgaacagccgtagagacgtagaacggctacggtntagtactaagttacgnggtagngagtagttagttgttacgtaaccgttntttaagatagttccgggtaagggaaccgtaaaggg

SEQ ID NO: 308264 - DNA, 685 bp, Homo sapiens
  misc_feature: GZ8MTXP01DH4FK.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactaaacacagaggactcgccatggagtttgggctgagcttgggttttccttgttgctatttaaaaggtgtccagtgtgaggtgcagcgtgggtggaggtcgtggggggaggcttggtccgaggccgtggggggtccctaggaaactctcctgtgcagcctctggatacacgtcaagtagtaacctccatagaacgtcgggtcccgcgaggcctccggaggggaacggggcgtggaggtcgggtctacgtaagtttagtttaagtaggtacgggtaggtaaacaaccgtaactacgtaaccggactaacggtaaacccgttaccgggtaacgggaaacggggacctaaacggtactttaccaacctactacccgttacccaaggaactaacgtaaacttaccgaaggaaacacgtcttacgtattacttaacaaattacgaaacgtacgtaccgtagaagtaggacgaacggacgaacggtctagtactagttacgtgtcgaggtaagagtagtggttacgttcgttagttttcgaattcgtcgggtacgggaccgtaagggttaactaacggg

SEQ ID NO: 308265 - DNA, 644 bp, Homo sapiens
  misc_feature: GZ8MTXP01B59T6.9.12.B01.1.454.CMB.2.raw
  modified_base (245)..(245): a, c, t, g, unknown or other
  misc_feature (245)..(245): n is a, c, g, or t
  modified_base (322)..(322): a, c, t, g, unknown or other
  misc_feature (322)..(322): n is a, c, g, or t
tcagtgatacgtctcacgaccggtgctcgatttagtagtgtagattcggcggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctcctgcactggaaccagcagtgactagtttgggtntactttaataactattcgtcctccgtggtaaccaacagccaacccgaggaccaaacgtccccaaatcatgtatttangagtacaaagtaacgcgtccctcggtcgggtccctgactcgtcttctcgtggctacgagtcgtacgaccaacgaccggtccctcccgtgacccgttctcgtcgggctcgaggtctaggacgagtggacggtcttagtaatttacttacgtgaccgtagtcttacgtatacgtcgaccgacggacccaaaccctataagttcgttaccgttagggaaacgtcgggaaacccgtcggttccgtaaccggttccgttaacggttccaccggaaccccgaaccggaaccctaaccccgtagttccgtaaccgttaaccgtttcccg

SEQ ID NO: 308266 - DNA, 733 bp, Homo sapiens
  misc_feature: GZ8MTXP01AMPLI.9.12.B01.1.454.CMB.2.raw
  modified_base (260)..(260): a, c, t, g, unknown or other
  misc_feature (260)..(260): n is a, c, g, or t
  modified_base (368)..(368): a, c, t, g, unknown or other
  misc_feature (368)..(368): n is a, c, g, or t
tcagtgatacgtctcacgaccggtgctcgatttagtagtgtagattccgcggggattgtgaagtgagctacaacaggcaggcagggggcagcaagatggtgttgcagacccaggtcttcatttctctgttgctctggatctctggtgccgtacggggacatcgtgatcgacccagtctccagacctcccgtggctgtgtctcgtgggcgaggacgggccaaccatacaactgacaacgtccagccaggtagttgtttacncggcctaccgaacaaacaacgaacttacgttagtcgttggtactcgaagacaaacgaaaccgaggaaccacgtaccctaactaaactcgacctactaacgttaaccgnggactacgtacccgtaccccccggaccgtaacggtccccggggtaccctacggtaaccctaacttcgagtcgggccgacgggtaccgggtcgtagggaactacgttacttccactcctaccaactactcgagcccacgtcccgtaggacccgtaagggtcaaaggtaaggtgttgggtaccggtacttttaaggtttactttaaccgtacgttaacgtaaaccggtttttcggtttccggggaaccgggttcccggttaaccgggtaaccgggaacggggttaaaaccgagggtttaaacggaaaacttaaaccccggtaaaaggtcgtcgggttacggacttaccggaaccttaacccgttaag

SEQ ID NO: 308267 - DNA, 667 bp, Homo sapiens
  misc_feature: GZ8MTXP01DBC7S.9.12.B01.1.454.CMB.2.raw
  modified_base (579)..(579): a, c, t, g, unknown or other
  misc_feature (579)..(579): n is a, c, g, or t
  modified_base (618)..(618): a, c, t, g, unknown or other
  misc_feature (618)..(618): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtggggggaggcttggtccaggccgtggggggtccctgaaactctcctgtgcagcctctggatacaccgtcagtagtaactccatgaacgtgggtcccgccgaggcctaccgagggggaagggggcgtggaggttgggtctcgtaagtttatttagtacggtaccggtaggtaaacacaataacctaacgtacaacgaccgtcccggtaagggaacggggtacaaggtacttaccaacctaatccctacaaggaacaaaccaaagttccccaaagggaaacccaccgtacttacgttaattcctttaaacgaaaattcggaaacctacgacctagggaagagggtaccgaaggtaccgaaccgggttnttaagttaactagttacgtggttaggacgaagttagttnttcggttaacgtactttgtttagattacggtcgggttaacggggaaccg

SEQ ID NO: 308268 - DNA, 567 bp, Homo sapiens
  misc_feature: GZ8MTXP01BX2GS.9.12.B01.1.454.CMB.2.raw
  modified_base (305)..(305): a, c, t, g, unknown or other
  misc_feature (305)..(305): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtcagtgtgaggtgcagctggtggagtcgtgggggaggcttggtccagccgtgggggtccctgaaactctcctgtgcagcctctggatacaccgtcagtagtaactccatcgaacgtgggtcccnccgaggcgtccgagggggaagggggcgtgggaggtgggtctcgtagtttatttagtagcggtgtaaccacatactacgcaagacgtccgtgaagggcagacttcacctatcctacagagacaattccaaggaactcgctgtatcttacaaatggaactgcctagagngtcgagacaggtcttgtatntaacgtgttaggcgagagtattggttcgttacgtgttttgaattcgtcggttacgggggaaccaagggggtaacc

SEQ ID NO: 308269 - DNA, 599 bp, Homo sapiens
  misc_feature: GZ8MTXP01DWN3Q.9.12.B01.1.454.CMB.2.raw
  modified_base (247)..(247): a, c, t, g, unknown or other
  misc_feature (247)..(247): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagtagttgtttanacggctccgaacaaacaaagaactacttagcttggtatcagcaaagaaaccaggacacgacctactaaactgctactaattaactggacatccgtacccccggcaaacgtccgggtccctagaaccctattcgaggtcgggcacgggcgggtcgtagggactacgtatttcaactctacaaccctagtacaagccaagccctgacgacgggacttaggaaagtgtggtggtactagttttacttacgtgtacctaacgttacgtttcgaacgggtcgttacggaccgaaaggaccgtaaaggttaggttaaacacgtaaaccgagtggttacgcgttacgtcgaaccctaag

SEQ ID NO: 308270 - DNA, 617 bp, Homo sapiens
  misc_feature: GZ8MTXP01A5GWI.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagagttgtttatacggctaccgaacaacaagaactacttagcttggtatcagcaagaaaccaggacacgcctacctaaactgtcctactacttaacgtgggactacgtccgtaaccccccggctaacgtcccggggtccctagaacccgtattcgagtcggacagggtcgggtcgtgggacagtattcactctacacactcagtcagtccagacgaggcgtagaaagtgtagtcggtacttagtttacttactcgtacttaacgttacggtttcgcgggttccgttcggtaccggaaacgggtaacccgtaagggttacggttaaacgttaccgaaaacggtacctaagggttcggacgttacggaaccttaaccgttaacg

SEQ ID NO: 308271 - DNA, 683 bp, Homo sapiens
  misc_feature: GZ8MTXP01EV6EB.9.12.B01.1.454.CMB.2.raw
  modified_base (264)..(264): a, c, t, g, unknown or other
  misc_feature (264)..(264): n is a, c, g, or t
  modified_base (634)..(634): a, c, t, g, unknown or other
  misc_feature (634)..(634): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggagcttggtccagccgtgggggtccctgaaactctcctgtgcagcctcnggatacaccgtcagtagtaactccatagaacgtcgggtccgcgaggctccgaggggagggctgggaggtgggtctctagtttattagtagtggtagtaaccacatacacgcaacgactccgtaggaacgggcaagtacttaccaacctagtccctaccgaaggaacgaacctaaacttacccggaaagggaaacctaccgggtacttacggttaaacttcctttaaacaaaacgttcggggaaaactacggacccgttaggaaacgtacggaccggaacgggaacctaccggggtcttaaggttaacttaagttaaccggttggaggacggttaaggacgttagttacgggttcgtttaacccggttttntttaggaacgttacggtacgggttacggggaaccgttaaaggggtaacc

SEQ ID NO: 308272 - DNA, 679 bp, Homo sapiens
  misc_feature: GZ8MTXP01D7W9P.9.12.B01.1.454.CMB.2.raw
  modified_base (271)..(271): a, c, t, g, unknown or other
  misc_feature (271)..(271): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggtttccttgttgctatttaaaggtgtccagtgtgaggtgcagctggtggagtcgtgggggaggcttggtccagccgtgggggtcctgaaactctctgtgcagctctggatacaccgnagtagtaactccatcgaacgtcgggtccgccgaggcctacgagggggaagggcgtgggaggtgggtctacgtagtttatttagtagtcggtacggtaacacatactacgacagcgtccgtaggaagggcagtacttcaacctagtctaccagacgaactaacttaccgaaggaacacggtactacgtacttacctttaaacgaaacttacgaaaccgtagtacccgtagggaaaccgtacggtaccggaaagggaaccgtacccgggtacttacggttaattaaaccgtttacgttacgggttagaccggtaaaggtaacggttacgttaggttacggtttaaacccgggttttcgttttaacggtaacgttacggttaccggggtaacgggggttaaccgtaagggg

SEQ ID NO: 308273 - DNA, 699 bp, Homo sapiens
  misc_feature: GZ8MTXP01BF01P.9.12.B01.1.454.CMB.2.raw
  modified_base (293)..(293): a, c, t, g, unknown or other
  misc_feature (293)..(293): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggcccaccatcaactgacaagtccagccagtagttgtttagacggctaccgaacaaacaagaactacttagcttaggtancagacaagaaaccaggacacgcctacctaaactgacctactaacgttaacgtgggacctacgtacccgtaccccccggactaaccggtcccggggtacccctacggaacccgtagttcgagggtcgggaccgtacgggtccggggtacgtaggggactagttactttaccaaccttcctaccaaccctacgtacaacgcctacgccgtacgacgacgggtcgtaggaaacggtagttacgggtagtacgtttagttttaattacgtcgtaacgtaacgtttcggttttccggccggggttcgttaccgggaccggttaaaggggtaaccggtaaagggttaacggttaaacgttaaccggtaaaacgtacgttaacggtcgggtacacggtaacccttcgttaacg

SEQ ID NO: 308274 - DNA, 641 bp, Homo sapiens
  misc_feature: GZ8MTXP01EUF2P.9.12.B01.1.454.CMB.2.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgaccagtctccagacctcctggctgtgtcntgggngaggcgcgcagtcactgacatcagcngagtnttanacgctacganacagatactagctgtaacncagacaagaacgagacacncacctactcgactactaactacgtacgactacgtaccgtaccccgtaccgtacgtccggtaccgtacgtaacgtacgtcgagcgcgacggcggtacggtacgacgtacgtacttactactaccacacacacacacgacgcgtacgtacgacgacgggagtaggtacggtacggtacggttacgtttaacgtttaacgtttacgttacgttacgttaaccggttacggtttaccgggttccgggttaccgggttaaccgggtaaacccgggaaacgggtaaacgggtatttaccgaaaacggttaaaccgtaaacgtacggtaacggtacggtacgttaccgtaaccgttaacgtaacg

SEQ ID NO: 308275 - DNA, 547 bp, Homo sapiens
  misc_feature: GZ8MTXP01BGLBG.9.12.B01.1.454.CMB.2.raw
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (513)..(513): a, c, t, g, unknown or other
  misc_feature (513)..(513): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctctggatacaccgtcagtagtaactccatgaactgggtccgccaggctccgaggggaggggcgtgggagtgggtctcgtagtttatttagtaggcggtagtaaccacatactacgcaaacgacctccggtagaagggcagtacttcacactctaccagagacaattccaaggaacacgctgtactctanaaatgaacagctgagngcgagacagtctagatataangttcgngagagtnttgttgttacgtntttgaattgtcggttggggtaaccaaggggtaac

SEQ ID NO: 308276 - DNA, 612 bp, Homo sapiens
  misc_feature: GZ8MTXP01C1EBN.9.12.B01.1.454.CMB.2.raw
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
  modified_base (570)..(570): a, c, t, g, unknown or other
  misc_feature (570)..(570): n is a, c, g, or t
  modified_base (584)..(584): a, c, t, g, unknown or other
  misc_feature (584)..(584): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagcttgggttttccttgttgcttatttaaaaggtgtccagtgtgaggtgcagcgtgggtggagtcgtgggggaggcgttggtccagccgtggggggtccctgaaactctcctgtgcagcctctggactacaccgtcagtagtaactccatgaactgggtcccgccaggcgtaccggagggggaaggggcgtgggaggttgggtctcgtagtttagtttagtaggtccggtaggtaaacacgactaactaaccgcaagacgtacccgggtagaacgggcagtacttcacctatctacagagaacaattaccgaaggtaacacggtactagttaacttaccttaacaaacttaggaaaccacgacctaggagacgtacggaagacgacgcttagtaactaattacgngttgaggngaagttnttggtaagtacgtnttttaggattagtcggttcggggaaccg

SEQ ID NO: 308277 - DNA, 725 bp, Homo sapiens
  misc_feature: GZ8MTXP01CS9JU.9.12.B01.1.454.CMB.2.raw
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
  modified_base (637)..(637): a, c, t, g, unknown or other
  misc_feature (637)..(637): n is a, c, g, or t
  modified_base (658)..(658): a, c, t, g, unknown or other
  misc_feature (658)..(658): n is a, c, g, or t
  modified_base (686)..(686): a, c, t, g, unknown or other
  misc_feature (686)..(686): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgcatggtagtttgggctgagtcgttgggttttccttgttgtacttaattttaaaaggtgtcagtgtgaggtgcagngtggtggagtcggtgggggagtcgttggtccgacggtccggtcggggggtccctagtaaacctccgtccgtgtcgcacgtcctcgtgaactaccgaccgtanaagtaactaactacagtacgaacggtcggtccgccgacggcgtaccggaagggggacgggcgtagggtacggttcgggtacttacgttaagttttaagtttaaggtacggtacggttaacggtaaaacccctaacgtaaacttacgtaaccggtaccgaaaacggtacccgttccgggtaaagggaaacgggacgtacgtaacttaccaactacgttacaacgaaacggtacaacgtaaactacccgaaaaggaactacgtcgtataacttactaaacaaacgtcggaaacctaggtccaagggacgacggtaccgaaggtaccgacgtnttattaaagtgttaactgggngagaagtagtatttgttcgttacgtttntagtgtaacggtcggttaacggggaaccgttaaagggtc

SEQ ID NO: 308278 - DNA, 607 bp, Homo sapiens
  misc_feature: GZ8MTXP01DJDE7.9.12.B01.1.454.CMB.2.raw
  modified_base (262)..(262): a, c, t, g, unknown or other
  misc_feature (262)..(262): n is a, c, g, or t
  modified_base (456)..(456): a, c, t, g, unknown or other
  misc_feature (456)..(456): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttcctgttgctattttaaaggtgtccagtgtgaggtgcagctggtggagtcgtgggggaggcttggtccagccgtgggggtccctgaaactctcctgtgcagcctntggatacaccgtcagtagtaactccatgaactcggtccgcaggctcgagggagggctggagtggtctctagttattagtaggcggtagtaaccactatacgtacgacaacgactcgtaggaaggcagtacttacacgactctaccgagtaacgaactaacgttaccgaaggaacacgtcgtagttactacttanaaaatgggtaaacagtacccgtagaggtacgtacggaacggacacgggtccttaggtaattacgttaacgtaggttgaacggagtaaagtgttaggttcgttaccgttgtttagaagttacgtcgggttacgggtaacgaaacgggtaacg

SEQ ID NO: 308279 - DNA, 620 bp, Homo sapiens
  misc_feature: GZ8MTXP01B8GJ7.9.12.B01.1.454.CMB.2.raw
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagtagttgttttanacggctaccgaacaaacaagaactacttagcttggtatcagacagaaaccaggacagcctactaaactgctacaattaacgngggcatcctacccggacaacgtccccggggtcccngaccgtattcgagtggcaggcggggtcgtcgggggcagtactttcactctccaaccatcgagcagcctgcgaggcagacgagtgtggtacttagtttattacgtgtactaacgttaggttttccgtcggggggttcggtttacgggaccgtaaacggggtaaccgtaaagggtacggaaaacttaaccgaaacgtaacgtggtacggctaacggaccttaccgattccgttcgttcttacgttcttcccttccccgctaacgtcgtacgacgtaaccgttaagtaacccg

SEQ ID NO: 308280 - DNA, 553 bp, Homo sapiens
  misc_feature: GZ8MTXP01EOUYH.9.12.B01.1.454.CMB.2.raw
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
  modified_base (519)..(519): a, c, t, g, unknown or other
  misc_feature (519)..(519): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggctccgaggggagggctggagtgggtcctgtagttatttagagtcggtggtaaaccacgatactacgcaagactccgtgaagggcagattcacatctcaganacaattccaaggacacgctagtactcttanaaatcgaaacngcctagacgagtccgagacacggntagtatattaacgtgttgacgagagtagttgttacgttacggtttntttagaatacggtggttacgggaaccgaagggtc

SEQ ID NO: 308281 - DNA, 554 bp, Homo sapiens
  misc_feature: GZ8MTXP01ASJ4O.9.12.B01.1.454.CMB.2.raw
  modified_base (247)..(247): a, c, t, g, unknown or other
  misc_feature (247)..(247): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccacatcaactgacaagtccagccagagttgtttanacggctcgaacaaacaagaactacttagcttaggtatcagcaagaaaccaggacagcctactaaactgactacattaacgtggacacgtaccgtacccccggacaacgtcccggggtaccctggaaacccgtattccgaggtcggacgtacggcggggtcgtaggggacagtacttcactctacacatcacgcacgcctagcgtagcgtagaagtagtgtgtctagtttatactgtactaactcgtttcgcggtcgttcgacgaacgggacaaggttgaattacgaaacgagtgngcttgcncgtaa

SEQ ID NO: 308282 - DNA, 629 bp, Homo sapiens
  misc_feature: GZ8MTXP01B07P3.9.12.B01.1.454.CMB.2.raw
  modified_base (476)..(476): a, c, t, g, unknown or other
  misc_feature (476)..(476): n is a, c, g, or t
  modified_base (536)..(536): a, c, t, g, unknown or other
  misc_feature (536)..(536): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (587)..(587): a, c, t, g, unknown or other
  misc_feature (587)..(587): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagcttgggttttccttgttgctattttaaaggtgtccagtgtgaggtgcagcgtggtggagtcgtgggggagcgttggtccagccgtgggggtccctagaactctcctgtgcagcctctggactacaccatactagtaacgtaactaccagtacgtaacggtcggtcccgaccgcggccgtacggagggggaagggcgtgggtaggtcggtcgtgtagtttattagtaggtacggtaggtaaccactactactacgacgagaacccgtacgtaaggaagggcagtctaccacctatcctaccaagacctaacactaccgaacgtaaccacgtntacgtacttactaaacaatacgaacgtcgtcagggaacgtgaccggagacgtacgggttnttaagtagttagtgnggngagtagttgtagttcgttcgttcgttagttaanagttcggtacgggaccgggttaacgtaacggttaacgtaacg

SEQ ID NO: 308283 - DNA, 754 bp, Homo sapiens
  misc_feature: GZ8MTXP01ACBCW.9.12.B01.1.454.CMB.2.raw
  modified_base (257)..(257): a, c, t, g, unknown or other
  misc_feature (257)..(257): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggagcttggtccagccgtgggggtccctgaactctcctgtgcagcctntggatacaccgtcagtagtaactccatgaactgggccgccgaggcctccgaggggaagggcgtggaggtgggtctcgtagtttatttagtagcggtggtaaacactactacctacgactaacggacctacccgggtaggaacggggtcaaaggtactttccaaccctattccctacccgaaggaaacgtaacctaaaacgtttcccgaaaggggtaaacccaccggtaccgttagtttaaacttcctttaaacgaaaagttcgaaaaaccgtacggggtcccgttaaagggaacggaaccgggttaccggaaacggggaaccgtacccggggttcttaaaggtttaatttaaacgtttaacccggtggttaaccgggacggttaaagggtaggttaaagttcggggtttagttaccgggttacgttttttagggaacttttaacggtccgggttaacggggggaccccaaaagggggtttcaaacggtttcccgggg

SEQ ID NO: 308284 - DNA, 585 bp, Homo sapiens
  misc_feature: GZ8MTXP01EF9LH.9.12.B01.1.454.CMB.2.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (388)..(388): a, c, t, g, unknown or other
  misc_feature (388)..(388): n is a, c, g, or t
  modified_base (463)..(463): a, c, t, g, unknown or other
  misc_feature (463)..(463): n is a, c, g, or t
  modified_base (580)..(580): a, c, t, g, unknown or other
  misc_feature (580)..(580): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatcgacccagtctccagacctccgtggctgtgtctcgngggcgagacggccacatcaatgacaagtccagccagtgttgtttanacggctccgaanaacaagaactatagcttgtacncagcaaagaaaccaggacacgccttaactaaactcgacttactaagttaacgtggacacgttccgtacccccggactaaacgtccggggtacccctggaaacccgtnttccgagtcggaccgaggcgggtacgtagggactagtactttcactctacactactcagccagcccgtagaccgngggtactaggaacgtagtggtagacttagtttacgtaactcgtactaacgttcgtttcgcggtcttacggaccaaagggcgtaagaggttaacttacgaacagtgaggcttgaaccncgtaa

SEQ ID NO: 308285 - DNA, 635 bp, Homo sapiens
  misc_feature: GZ8MTXP01EE35D.9.12.B01.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacgggacatcgtgatcgacccagtctccagacctccctggctgtcgtctcgngggcgagacggccaccatcaactgacaagtccagccagagttagtttagacggctaccgaacaacaagaactacttagcttaggtacncagacaaagaaaccgagaacacgtaccctaacctaaactgacctactaacttaacgtgggacctacgtacccgtaacccccggactaaacggtccccggggtaccctacggaacccgtattccgaggtcggacgtacgggccgggtacgtagggactagtacttcactctacacatcagcgcgacctgacgacgtcgtagaagtagtcggtgtacttaagtttacttaactgtaacctaacgttcggtttcggcggggtacgttcgggaccgaaagggaacccgtaagggttaacggttaaacaacgtaaaacggctaagggtcgacttaccgcgttaacctaag

SEQ ID NO: 308286 - DNA, 614 bp, Homo sapiens
  misc_feature: GZ8MTXP01ESQRW.9.12.B01.1.454.CMB.2.raw
  modified_base (310)..(310): a, c, t, g, unknown or other
  misc_feature (310)..(310): n is a, c, g, or t
  modified_base (498)..(498): a, c, t, g, unknown or other
  misc_feature (498)..(498): n is a, c, g, or t
  modified_base (566)..(566): a, c, t, g, unknown or other
  misc_feature (566)..(566): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctgggtggagtcgtgggggaggtcgttggtccagccgtgggggtccctgaactctctgtgcagcctctggatacaccgtcagtacgtaactccatgaacgtgggtcccncgaggcctccggaggggaacgggcgtggtaggtgggtctcttagtttattagtaggtccggttaggtaaacactataccgtaaccgacaacgtaccgtaccgggtaggaacgggcagtacttacaccatcctacagactactaacttacgaagacacgccgtagtacttactaacgaaatacgaaacncgaccgtagacgtacgtacgaagggacctacggctaggtaacttagttagtgttcgagtaagaggttnttcggtaagttcgtgttttagacgttacgtcggttaacgggaaccggg

SEQ ID NO: 308287 - DNA, 682 bp, Homo sapiens
  misc_feature: GZ8MTXP01B62WC.9.12.B01.1.454.CMB.2.raw
  modified_base (344)..(344): a, c, t, g, unknown or other
  misc_feature (344)..(344): n is a, c, g, or t
  modified_base (487)..(487): a, c, t, g, unknown or other
  misc_feature (487)..(487): n is a, c, g, or t
tcagtgatacgtctcacgaccggtgctcgatttagtagtgtagattccgcggggattgtgaagtgaactacaacaggcaggcaggggcagcaagatggtgttgcagacccaggtcttcatttctctgttgctctggatctctggtgcctacggggacatcgtgatgacccagtctccagacctcccgtggctgtgtctcgtgggcgaggacggccaacatcaactgacaagtccagccagtagttgttttacacggctaccgaacaaacaagaacttactagtcgttagtatcagacaagaaaccaggacacgtaccctacctaaactgacctactaattacgnggactactcccgtacccggactaaccggtccggggtaccctcggacccgtaattccgaaggtcggacggtacgggtccggggtcgtacggggactaagttactttccgaaccttctaccgaaccagttacacgcaacgtccgngacgtagtacgaggggaagttaggtggtacgttacgttaagtttacttacgtacgtaaccttaacggtttcggtttccggtcggggtaaccgtaacggaaaccgggtaaacggttaccggtaaaggtaacgttaaacgttaaccgttaaacggtaacgtcggtaacgtacgtcgttaacctaacgttaacgttcg

SEQ ID NO: 308288 - DNA, 687 bp, Homo sapiens
  misc_feature: GZ8MTXP01EZNMZ.9.12.B01.1.454.CMB.2.raw
  modified_base (509)..(509): a, c, t, g, unknown or other
  misc_feature (509)..(509): n is a, c, g, or t
  modified_base (518)..(518): a, c, t, g, unknown or other
  misc_feature (518)..(518): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgaccagtctccagacctcctggctgtcgtctcgtgggcgaggacggccacctatacaactgacaacgtccagtacctagtttacgtttttacgacggtcctaccgaaacaaacaaagtaaacctacgttagtacgttaggtatacgaagaccaaacgaaaaccgaggaccacgtacccctacctaaaactcgtactaactaacgtttaacgcgggacctacgtacccgtacccggtaccgtaaccggttcccgggggtaccctacggtacccgtaaacttcgtaacgggtcggacgacgggtacgggtcgtaggggactacggtactttccacttccacacntacacgccncgctgcgtacgtactaggggtacgtagtcgtacgtacttagttacttagtacgttacgttacgtttcggttcggcgggtcggtacgggaaccggtaaacgggttaacgtaaagggtaacttaaacgttacgttaacgtaacgtggtaacgctacgaccgtcgttcgttc

SEQ ID NO: 308289 - DNA, 535 bp, Homo sapiens
  misc_feature: GZ8MTXP01AGAG9.9.12.B01.1.454.CMB.2.raw
  modified_base (366)..(366): a, c, t, g, unknown or other
  misc_feature (366)..(366): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatcctacccccggcaatcccgggggtccctgaacccgattcngtggcagcggggtctggggacagtatttcactctcacatcagcagcctgcaggcgtgaagatgtggctagtttattactgtcaactagttttcgtcggggtcgttcgggtccgaacgggaccgaagggttggaaacttacgaaacgactggtggcttcgcgaacctaac

SEQ ID NO: 308290 - DNA, 642 bp, Homo sapiens
  misc_feature: GZ8MTXP01DAF29.9.12.B01.1.454.CMB.2.raw
  modified_base (589)..(589): a, c, t, g, unknown or other
  misc_feature (589)..(589): n is a, c, g, or t
  modified_base (597)..(597): a, c, t, g, unknown or other
  misc_feature (597)..(597): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcgttgggttttccttgttgcttaattttaaaaggtgtccagtggtgaggtgcagcgtggtggagtcgtgggggaggtcgttggtccgacggccggtcggggggtaccctagaaacctctccgtgtcgcacgcctctggatacacgcagtagtaactcatagacgtcggtccgccgaggctaccgagggggaacgggcgtgggaggtgggtctacgtagtttattaagtaggtcggtacggtaaaccactaacgttaacaccggaacaagaaccgtccggtagggaaacgggacaagacttacaacccattcccaccgaagaacaaccaacttacccgaaggtaaaccacggtctagttaacttactaaacctaaagtcgaaaactcggacctggaacggtagaccgaacggtaccacgggtacttgtaataaccttagngtgagagngttcttgttacgtaatctttggaatgcgtaacgggaacgtaaagg

SEQ ID NO: 308291 - DNA, 675 bp, Homo sapiens
  misc_feature: GZ8MTXP01ENAY5.9.12.B01.1.454.CMB.2.raw
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggtttcgtgtaggctattaaagtgtcagtgtgaggtncagngtggtggagtcgtgggggagcttggtccaggccgtgggggtccctagaaactctctgtncagcctgtggatacaccgttnagtactactcagtacgacgtcggccgcgacggcgtacggaggggacgggtcggtaggtaggtcggtacgttacgttagtttagtttagtacggtacggtacgtaaccgtacgtaacgtacgtacgtacgaacgtacgtcgtacggaacggacgtacgtactactactacgtacgacgaacgaacgtaacgtaacgtaacgaacgaacgtacgtacgtacgttacttaactaacgtaaacgtaacggtaacgtacgtaccgtacggtaacgtaacggtacggaacggtaacgtacggtacgttacgttaagttagttaacgtagttaggtagaggtagtagttagttacgttacgttaagttagtaacgttacgtacggttacggtaacggttaacggtaacg

SEQ ID NO: 308292 - DNA, 562 bp, Homo sapiens
  misc_feature: GZ8MTXP01A5Y0K.9.12.B01.1.454.CMB.2.raw
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttcctgttgctatttaaaaggtgtccagtgtgaggtgcagctggtggagtcgtgggggaggcttggtccagccgtggggggtccctgaactctcctgtgcagcctctggatacaccgtcagtagaactccatgaacgtgggtcccgccgaggctaccgaggggtaacggggctgggaggtgggtctctagtttatttagaggcggtaggtaacacactactacgcagtacgtccgtaggaagggcagattcaccgatctaccagtacaactaattcccaaggaacctacgctagtatctacgaaatgaacagcctgacgagtcgaggactacggntagtatatacgtgngngaagcagtcgtgttacgttntttggaacctgtcggtggggacccaaagggtcaagtcgg

SEQ ID NO: 308293 - DNA, 551 bp, Homo sapiens
  misc_feature: GZ8MTXP01EMFRL.9.12.B01.1.454.CMB.2.raw
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
  modified_base (508)..(508): a, c, t, g, unknown or other
  misc_feature (508)..(508): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctntggatacaccgtcagtagtaactccatgactggtccncaggctcgagggagggctggagtggtctcgtagttatttagtagtcggtaggtaaccacatacgtacgcaacgactcgtagaagggcagactcactatctacagagacaattcaaggacacgctatatcttaaanaatcgaacngcagagacgcgaggacgcgtntagtatattaagtggagagagagtagttgttcgttacgttntttaggaacttacggtcgggttacggggtaaccgaagggtaac

SEQ ID NO: 308294 - DNA, 744 bp, Homo sapiens
  misc_feature: GZ8MTXP01BE89C.9.12.B01.1.454.CMB.2.raw
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcttgggttttccttgttgcttaattttaaaaggtgtcagtgtgaggtgcagcgtggtggagtcgtgggggaggcgttggtccgagccgtggggggtccctagaaactctccgtgtgcacgcctcgtggactacaccgtcagtagtaactcatgaacgtggtccncaggctccgaagggggaagggctgggagtgggtctgtagtttattagagcggtagtaaacccanatactacgcaaagacctcgtaggaacgggcaggtattaccactactccgtaccaagtaacgaactaaacttcccgaaaggaacctacgtcttacgttaacttacttaaacaaaacgttcgggaaaaccgtacggtaccccgttaaggggaaacgttacggggtaccggaaacgggaacccggtacccggggttacttaacggtttaaatttaacgtttaaaccggtgggttacgggaaaccgggttaaggttaaacgggttaacgttgggtttacggtttaaaccgggtttcggtttttttaaggaaccgttttaacgggtcccggggttaacggggggaaccccgttaaaaggggggtaaaccccg

SEQ ID NO: 308295 - DNA, 686 bp, Homo sapiens
  misc_feature: GZ8MTXP01A9FKY.9.12.B01.1.454.CMB.2.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
  modified_base (637)..(637): a, c, t, g, unknown or other
  misc_feature (637)..(637): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgtcttaattttaaaaggtgtccagtgtgaggtgcagcgtggtggagtcgtgggggaggcgttggtccgagccgtgggggtccctagaaactctcctgtgcagcctntggactacaccgtnagtagtaactcatcgaacgtcggtccnccgaggcctccgaggggagggcgtggaggtgggtctacgtagtttattagtaggtcggtacggtaaccacgtataaccgtacgcaaacgtaccgtccggtaggaaacgggcagtacttaccaacctactccctaccgaaaggaacgtaacctaaacgttccgaaacgggaaacctcggtacttaggtaaccttacttaacgaaaacgtcggggaaactacgtccgtaaggaacggtaacggtccggaaaggtaacccgtaggtacttaaggttaacttaagttaacgtggttcgacgttaagagtagttggttcgttaccgtttnttttaggaactttacggtcggttacggggaaacccgttaaggggtaacc

SEQ ID NO: 308296 - DNA, 650 bp, Homo sapiens
  misc_feature: GZ8MTXP01EXN2J.9.12.B01.1.454.CMB.2.raw
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcgttggtccaggccgtggggggtccctgaaactctcctgtgcagcctctggatacaccgtcagtagtaactccatgaactgggtccgccgaggctaccgagggggaagggggctgggaggtgggtctcgtagtttattagtacggtccggtaggtaaacacgtactaccgtaaacgcaacgaccgtcggtaggaacggcaagtacttaccacctatcctaccgaagacgtaactaaacttccgaaggaacacgtctagtaacttacttaacaaattacgaaaccacggtacccgtaggaacggtacggtaccggaacgggacctacgggtccttaagtaattacgtttacgtggttacggacggtaagttaggttattggtaagtaccgttgtttttgaacgttacgtcgggttcgggggaaacccgg

SEQ ID NO: 308297 - DNA, 616 bp, Homo sapiens
  misc_feature: GZ8MTXP01D6DCE.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctactaaactgctcaattaactgggcatctacccggcaacgtccgggggtccctgaccgatttcaggtggcagcgggtctgggacagattcactctcaacatcagcagcctgcaggctagaagatggtggtactagttttacttacgtgtactaactagttttccgtcggggggtacgtttcgggacccgtaaaggggacctaaaggggttggaaaacttaaccgaaaacgtaccgtaggtgggtccttaacggaccgttacctaacgtttctacggtttcctttacgttacgtttcccgtttaacccccgacttaacttacgttacgaacgttaacccggttaattcccgg

SEQ ID NO: 308298 - DNA, 684 bp, Homo sapiens
  misc_feature: GZ8MTXP01A9CMN.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagcgtggtggagtcgtggggggaggcgttggtccgaggccgtggggggtccctggaaactctcctgtgcagcctcgtggactacaccgtcagtacgtaactccatagaacgtcgggtccgccaggctaccgagggggaaggggcgtgggaggtggggtctcgtagtttagtttagtaggtcggtaggtaaccactatactacgacaaacgtacgtccggtaggaacgggacaggtacttacgacccattccctaccgaaggactaactaaagttcccgaaagggtaaccacggtcttaggttaactacctttaaacaaaacgttcggaaacacggtacccgtaggaacgtaacggtcggaacgggacctaccgggtacttaaggttaattacgttaagtcggttggaacgaggtagtaagttggttcgttaccgtttgttttaggaacttcgggtacgggttaccgggggaaccgttaaagggggtaac

SEQ ID NO: 308299 - DNA, 716 bp, Homo sapiens
  misc_feature: GZ8MTXP01BFCNZ.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtcgccgtacggggacatcgtgatcgaccccagtcctaccagtacctcccgtggcttgtcgtctcgtgggcgaggacgggcccaccataccaactgacaacgtccaagccagtagttacgtttacgaccggctaccgaaacaaacaaagtaactacgttagtcttaggtactacacgaacaaacgaaaccgtaggaccacgtacccttaacctaaactcgtacctaacgtaattaaccggtcggacctaaccgtaccgtaaccccccggtacgtaaaccgtcccgggggtaccctggaaaaccccgtagttcgaggtcgggacgacgggtcggggtactacggggactagttactttacgacctactaccactaactaccgacgaccgacctccgtcggacgtacgggcgtaaaggacggttagtcgggtgtaactttagttttactaacttcgtaactaccggttggttttccggcggggtaccgttacgggaaccgttaaacggacggtaaaggaagttaaacgaacgtaaaaccgtgtaacggtcggtacgttacgtaaccaacgttaac

SEQ ID NO: 308300 - DNA, 656 bp, Homo sapiens
  misc_feature: GZ8MTXP01BGHH9.9.12.B01.1.454.CMB.2.raw
  modified_base (264)..(264): a, c, t, g, unknown or other
  misc_feature (264)..(264): n is a, c, g, or t
  modified_base (499)..(499): a, c, t, g, unknown or other
  misc_feature (499)..(499): n is a, c, g, or t
tcagtgatacgtctcacgaccggtgctcgatttagtagtgtagattccgcggggattgtgaagtgagctacaacaggcagggcaggggcagcaagatggtgttgcagacccaggtcttcatttctctgttgctctggatctctggtcgccgtacggggacatcgtgatcgacccagtctccagacctcccgtggctgtgtctcgtgggcgagacggccaccatcaactgacaagtcagcagtagttgttacaccggctacgaanaaacgaacgtaactacgtagcttaggtactcagacaaagaaaccgaggacacgccctaacctaaactgacctactaacgttaacgtcgggacacgttaccgaaccccccggtacgtaaccggttcccggggtacctacggaaacccgttattccggaggtacggacgacgggtcgggtcagggactagtacttcacttcacacactcagcacgtccaggagtacggcagaacgtntggtagcttaagttttacacgtcgtaacctaacgtttcggtttaaccggcggggttacgttcccgggaaacacggggaaaccgtaagggttaacggttaaacaacccgtaaaaccggtgtttcgggtccggacgttaacccgtaaccttaaccgtcg

SEQ ID NO: 308301 - DNA, 575 bp, Homo sapiens
  misc_feature: GZ8MTXP01DRVKI.9.12.B01.1.454.CMB.2.raw
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcttgggttttccttgttgctaattttaaaaggtgtccagtgtgaggtgcagctggtggagtcgtgggggaggcttggtccagccgtgggggtccctgaaactctcctgtgcagcctctggatacacgcagtagtaactcatgaactggtccgcaggctccgaggggaagggctggagtgggtctcgtagtttattataggcggtacggtaacacatactacgacagcgtcgtagaagggcagattcacatctacaagagaacaacttaccaaggaaccacgtctagtattacttacaaaagttcgaaacagccgtagacgagtcgaaaggactacggnttgtaataattaacgngttgacgtaagtattagttggttnttaacccggtttntttaagagtcgttacgggtaacgggaacgtaagg

SEQ ID NO: 308302 - DNA, 669 bp, Homo sapiens
  misc_feature: GZ8MTXP01A8HAD.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactaaacacagaggactcgccatggagtttgggctgagctgggttttccttgttgctattttaaaaggtgtccagtgtgaggtgcagctggtggagtcgtgggggaggcgttggtccagccgtgggggtccctagaactctcctgtcgcacgcctctggactacaccgtacagtagtaactccatacgaacgtcgggtccgaccgacggcctcggaaggggagggcgtggaggtgggtctacgtagtttaagtttagtagtcggtaggtaacactatactacgacacgaaccgtccggtgacgggacagacttacacctatcctacgagacgtaactaacgttacccgaaggtaaaccacgttctacgtaacttacttaacaaaacgttagaaaccttaacgcccgtaagaggtacggacgaacggaccgtaacggtccttaggtaacttaacttacggtggttaggacgaggttaaagccgtttggttacgttaaccggttgtttttaacgagtttcgaccgggtacgggggttactaaaacgggttgttaaaccgg

SEQ ID NO: 308303 - DNA, 669 bp, Homo sapiens
  misc_feature: GZ8MTXP01CSF0L.9.12.B01.1.454.CMB.2.raw
  modified_base (611)..(611): a, c, t, g, unknown or other
  misc_feature (611)..(611): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagcttgggttttccttgttgtcttattttaaaaggtgtccagtgtgaggtgcagctgggtggagtcgtgggggaggcgttggtccaggccggtcggggggtccctagaactctcctgtgcacgcctcgtggactacaccgtcagtacgtaactccatcgaacgtcggtcccgccgacggccgtccggagggggaacgggggcgtgggaggttcgggtctacgtagtttatttagtaggtccggtaggtaacacatacaacgacaacggtactccggtaggaagggcagtactaccacctatcctacagaacgaactaacttccaaggaaccaccgtactagttaacttcctttaacgaaacgttacgaaacctacggacccgtaggaacggtagtaaccggggacggtaaccgacgggtcttagttaaagttacttacggtcgaggtaacgtaggaggttnttcggttaaggttaccggttcttttaggactttacgtcgggttaacgggggtaacccg

SEQ ID NO: 308304 - DNA, 777 bp, Homo sapiens
  misc_feature: GZ8MTXP01EYC03.9.12.B01.1.454.CMB.2.raw
  modified_base (575)..(575): a, c, t, g, unknown or other
  misc_feature (575)..(575): n is a, c, g, or t
  modified_base (651)..(651): a, c, t, g, unknown or other
  misc_feature (651)..(651): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagtcgttgggttttccttgttgtacttaattttaaaaggtgtccagtgtgaggtgcagcgtggtggagtcggtgggggaggtcgttggtccgaggccggtcgggggtccctagaaacctctcctgtgcacgtcctcgtggactaccgaccgtacagtacgtaacctcctagtacggaacgtcgggtaccgaccgacggccgtaccggaagggggaacggggcgtagggtaggtcgggtacttacgtaagtttaagtttagtacggtacggtacggtaaaccactaagtaccgtacgacgtaaacgtaccgtccggtaggaaacgggtcacgtaacttaccgaacctacttaccctaccgaaaggaaacgtaacctaacgttacccgaaaggaaacccttccgtacgtttagtaaaccttccttaaaanaaaagttccggggaaaactcgggtacccgtagggaaccgtaaacgggtccccggaaaggtacccgtaaaccggttntttaaattaacgttaacgttggtaggttacggaaacgttaaggtacgttaggtttacggttaccggttacgtttaagtttagaacgttacgggtaccggggaacgggtaaaccgttaaagggtaac

SEQ ID NO: 308305 - DNA, 706 bp, Homo sapiens
  misc_feature: GZ8MTXP01A03NN.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacgggacatcgtgatcgaccagtctccagacctccctggctgtcgtctcgtgggcgagacggccacatacaactgactaagtccagccagtagttgtttacaccggctaccgaacaaacgaagtaactattagcgttaggaatcgaagcaaacgaaaccgaggaaccacgtaccctaactaaacgttcgaccttacgtaacgtttaaccggtcggacctaacgttccccggaacccccccggggtactaaaccgggtccccgggggttaccctacggaacccgttagttcgacgggtcgggaccgcggggtacggggtccgagggaactacggtactttaccacttccaccaactagtccgaacgcgtaacgcccgtaggcgtaacggcgtaaggaaaggtgtacggttgtaacctttaggtttaacttcgttagtaaccttacgtttcggttaccggtcgggtcgttacccgggaacgaaaggggtaacgtaacgggttaaacgaacgttaaccgaaacggttaacgtcggtcggttacacgccttaaccgttcg

SEQ ID NO: 308306 - DNA, 629 bp, Homo sapiens
  misc_feature: GZ8MTXP01DA0AH.9.12.B01.1.454.CMB.2.raw
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (508)..(508): a, c, t, g, unknown or other
  misc_feature (508)..(508): n is a, c, g, or t
  modified_base (534)..(534): a, c, t, g, unknown or other
  misc_feature (534)..(534): n is a, c, g, or t
  modified_base (629)..(629): a, c, t, g, unknown or other
  misc_feature (629)..(629): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatcgaccagtctccagacctcctggctgtgtctcgtgggcgagacggccaacatcaactgacaagtcagccaagtattgtttanacggtctaccgaanaaacaagtaactacgttagtacgttaggtataccagaccaaagaaaccaggacacgtaccctactaaaactgtaccttataacttaacggtggacctatacccgtaaccccccggactaacggttccccggggtaccctacggaaaccctaattccggaggttcgggacagggcccggggtattcgggaacagttattccactctaaccactacgcacgcacgtccaggccaaggtctaggaaagtntgggtacacttagtttactaacgttntacgtacgttcgtttcggcggtcggttacgaacgaaacggacgtaaaggttacgaaacttaccgtaagtacgtgacgacttacgtaaccaacgtn

SEQ ID NO: 308307 - DNA, 725 bp, Homo sapiens
  misc_feature: GZ8MTXP01A64SB.9.12.B01.1.454.CMB.2.raw
  modified_base (284)..(284): a, c, t, g, unknown or other
  misc_feature (284)..(284): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtcagtgtgaggtgcagcgtggtggagtcgtggggggaggtcgttggtccagccgtcggggggtccctagaaactctcctgtgcagcctcgtggatacaccgtnagtacgtaactccatgaacgtcgggtcccgaccaggcctaccggagggggaacgggggcgtaggggaggttcgggtctacgtagtttaacgtttaagtaggcggttaacggtaaactacgtaattaccgtaaccgacaacgtaaccgtacccggtagggaaacggggtccaaggtaacttacccaaccctaattcccgtacccgaaaggaacgtaaaccctaaactttacccggaaagggtaaacccaccgggtaccttaaggttaacttaccgtttaaccaaaagtttcgaaaacgacgtacccgtagaacggtacggtacgaaacgggactaacgggtacttaggtaattaacttacgttgttcgacggtaagagttaagttgttaggttaaaccgtgttttaaggattacgttccgggtaacgggcccgtaaaagggg

SEQ ID NO: 308308 - DNA, 508 bp, Homo sapiens
  misc_feature: GZ8MTXP02JFLNG.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctggggacagatttcactctcaccatcagcagcctgcaggctgaagatgtggctagtttattactgtcaactagtttctcgggcgtttcggccgaagggaccaaggtaggaaatcaaacgactgtggctgcaccatctgtctcatccttccgcatctagaacgtacgtatcg

SEQ ID NO: 308309 - DNA, 524 bp, Homo sapiens
  misc_feature: GZ8MTXP02HEW4F.9.12.B01.1.454.CMB.2.raw
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtcccagccagagtgtttatacggctccgacaacaagaactacttagcttggtatcagcagaaaccaggacagcctcctaaactgctcattaaactgggcatctacccccggcaatccggggtcctgaccgattcagtggcagcgggtctgggacagatttcactctcaccatcagcagcctgccaggctgaagatgtggcagtttattactgtcaactagtttctcgggtcgtttcggccgaagggacccgaacggtagggaaattacgaaaacgaactagtcggactcggcacctacg

SEQ ID NO: 308310 - DNA, 539 bp, Homo sapiens
  misc_feature: GZ8MTXP02GSYVI.9.12.B01.1.454.CMB.2.raw
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcaagaaaccaggacagcctactaaaactgctcattaactggcatctacccccggcaagtccggggtcctgaccgattcagtgcagcggtctgggacagatttcactctcaccatcagcagtccncgcagngagagagtgtgacgtagttattactacgtactactacgttcgttcggtcggtacggtacgaacggaacggaacggtaacggtaacgtaacgtaaacgtaacgtacgtacgtacgtacgacgactacg

SEQ ID NO: 308311 - DNA, 532 bp, Homo sapiens
  misc_feature: GZ8MTXP02HCIIA.9.12.B01.1.454.CMB.2.raw
  modified_base (372)..(372): a, c, t, g, unknown or other
  misc_feature (372)..(372): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccccggcaacgtccggggtcctgaccgatcagtgcagcgggtntgggacagattcactctcaccatcagcagcctgcaggctgaagatgtggctagtttatactgtacaatagtttctcgggtcgttcggaccgtaaaggggacctaacgggtaggaaactacgaaaacggtaacgtacggttaggacttcggactaccctag

SEQ ID NO: 308312 - DNA, 532 bp, Homo sapiens
  misc_feature: GZ8MTXP02G2QGC.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctacctaaactgctcattaactggcatctaccccggcaatccggggcctgaccgatcagtgcagcgggtctgggacagattcactctcaccatcagcagcctgcaggctgaagatgtgctagtttatactgtacaactagtttctcgggtcgtttcggaccgaacggggaaccaacgggtaggtaaacgtacgaaaacgtaaaccgtcggttaggactcggaccaaccgtaacg

SEQ ID NO: 308313 - DNA, 517 bp, Homo sapiens
  misc_feature: GZ8MTXP02GSQBV.9.12.B01.1.454.CMB.2.raw
  modified_base (244)..(244): a, c, t, g, unknown or other
  misc_feature (244)..(244): n is a, c, g, or t
  modified_base (336)..(336): a, c, t, g, unknown or other
  misc_feature (336)..(336): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (517)..(517): a, c, t, g, unknown or other
  misc_feature (517)..(517): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccaggacagcctactaaactgctcattaactggacatctaccccggnaacgtccggggtccctgaccgattcgagtcggcagcgggtctgggacagatttcactctcaccatcagcagcctgcaggctagaagntgngctagttatacgtgtactatcgtttcgtcggtcgttcggacgaacggacgacggtacgaactacgaaacgtacgtcgtcgctacgacactn

SEQ ID NO: 308314 - DNA, 519 bp, Homo sapiens
  misc_feature: GZ8MTXP02JAYJ8.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactgggcatctacccggcaatccggggtcctgaccgattcagtggcagcgggtctgggacagatttcactctcaccatcagcagcctgcagctagaagatgtggctagtttatactgtacaactagttttctcgggtcgttcggaccgaaggggaccaagggtaggaaaatacgaaaacgaactgtggactcgcacactctcgtctcatccttccgctactctagaacgacgtatc

SEQ ID NO: 308315 - DNA, 579 bp, Homo sapiens
  misc_feature: GZ8MTXP02G32S7.9.12.B01.1.454.CMB.2.raw
  modified_base (357)..(357): a, c, t, g, unknown or other
  misc_feature (357)..(357): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctcctaaactgctcattaactggcatctacccggcaatccggggtccctgaccgattcagtggcagcgggtctggggacagatttcactctcnccatcagcagcctgcaggctgaagatgtgctagtttatactgtcaactagtttctcgggtcgtttcggaccgtaacggggaccaaagggtagggaaaacttacgaaaacggaaaccttaggtacggccgttacggaccaaccctaattcgtacggttcctttaccaacgttacctttccccgcctaacgttcctaggtaaacggtaccgttaaacttacccg

SEQ ID NO: 308316 - DNA, 510 bp, Homo sapiens
  misc_feature: GZ8MTXP02G9BE2.9.12.B01.1.454.CMB.2.raw
  modified_base (244)..(244): a, c, t, g, unknown or other
  misc_feature (244)..(244): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactactagcttggtatcagcagaaaccaggacagcctactaaactgctcattaactggcatctacccccggcaacgtccggggtcctgaccgattcgagtgcagcgggtctgggacagattcactctcaccatcagcagcctgcaggctgaagatgtggctagtttatactgtacaactagtttctcgggtcgttcggaccgaaagggaccaggtagaaatacgaaacgactgtaggctcgacactac

SEQ ID NO: 308317 - DNA, 529 bp, Homo sapiens
  misc_feature: GZ8MTXP02GNVYG.9.12.B01.1.454.CMB.2.raw
  modified_base (453)..(453): a, c, t, g, unknown or other
  misc_feature (453)..(453): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgtttatacggctccgacaacaagaactactagcttggtatcagcagaaaccaggacagcctacctaaactgctcattaactgggcatctaccccggcaactccggggtcctgaccgattcagtggcagcggtctgggacagatttcactctcaccatcagcagcctgccaggctagaagatggtggactagtttattactgtacaactagttttcncgggtcgttcggaccgtaaacgggaaccgaacggtaggtaaatacgaaaacgaactaggtacggcgtacgcactac

SEQ ID NO: 308318 - DNA, 540 bp, Homo sapiens
  misc_feature: GZ8MTXP02ID2GD.9.12.B01.1.454.CMB.2.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctcgacaacaagaactacttagcttggtatcagcagaaaccaggacagccctctaaaactgctcattaaactgggcatctacccccggcaactccggggtccctgacccgattccgagtggcagcgggtctgggacagtattcactctcaccatcagcacgccncncngcgagagagtgtgngtagttattatcgtactactacgttcgtcggtcggtcggtacgaacggaacggaacggtaacggtaacgtaacgaaacgtaacgtacgtacggtacgtacgactactacg

SEQ ID NO: 308319 - DNA, 538 bp, Homo sapiens
  misc_feature: GZ8MTXP02HTFXZ.9.12.B01.1.454.CMB.2.raw
  modified_base (444)..(444): a, c, t, g, unknown or other
  misc_feature (444)..(444): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctgggggtccctgaaactctcctgtgcagcctctggatacaccgtcagtagtaactccatgaactgggtccgccaggctccgagggaaggggctggagtgggtctcagttattatagcggtggtaaccacatactacgcagactccgtgaagggcagattcaccatctccagagaacaattcccaaggaacacgctgtatcttacaaatgaaacngcctgagagtcgaggacacggctagtatattacgtgtgcgtagagtatgttgtacgtgttttagacttagcgttacggggaccgtaaagggaac

SEQ ID NO: 308320 - DNA, 555 bp, Homo sapiens
  misc_feature: GZ8MTXP02GDCUR.9.12.B01.1.454.CMB.2.raw
  modified_base (341)..(341): a, c, t, g, unknown or other
  misc_feature (341)..(341): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgaggaggccaccagtcaactgcaagtccagccagagtgtttatacggctccgacaacaagaactactagctggtatcagcagaaaccaggacagcctacctaaactgctacattaaaccgtggacactctacccccggnaactccggggtcctgaccgattcagtggcagcgggtctgggacagtatttcactctcaccatcagcagccncgcgacgcgtagagagtgtagtacgtagttattacgtacgtactaacgtacgttcgtcggtcggtaccggtacggaacggaacggaacggtaacggtaaacgtaacgtaaacgtaacgtacgtacgtacgtacgacgactacg

SEQ ID NO: 308321 - DNA, 528 bp, Homo sapiens
  misc_feature: GZ8MTXP02IOFQH.9.12.B01.1.454.CMB.2.raw
  modified_base (383)..(383): a, c, t, g, unknown or other
  misc_feature (383)..(383): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactactagcttggtatcagcagaaaccaggacagcctcctaaactgctcattaactggcatctaccccggcaacgtccggggtcctgaccgattcgagtggcagcgggtctggggacagtnttcactctcaccatcagcagcctgcagctagagatggtgctagtttatacgtgtctaatgtttcgtcgggtcgttcggaccgtaaagggacctaagggtaacggaaataccgaaaacgtactaggtcggactacggctaacctag

SEQ ID NO: 308322 - DNA, 519 bp, Homo sapiens
  misc_feature: GZ8MTXP02JFYD8.9.12.B01.1.454.CMB.2.raw
  modified_base (243)..(243): a, c, t, g, unknown or other
  misc_feature (243)..(243): n is a, c, g, or t
  modified_base (421)..(421): a, c, t, g, unknown or other
  misc_feature (421)..(421): n is a, c, g, or t
tcagtgatacgtctcacgaccggtgctcgatttagtagtgtagattccgcgggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggatcagcagaaaccaggacagcctactaaactgctcattaactgggcatctacccccggcaacgtccggggtcctgaccgattcagtggcagcgggtctgggacagatttcactctcaccatcagcagcctgcaggctagaagatgngctagtttatactgtcaaactgtttcgtcgggtcgttcggacgaaacgggaccgaacggtaggaaatacgaaaacgactacgtaggctacgacactag

SEQ ID NO: 308323 - DNA, 622 bp, Homo sapiens
  misc_feature: GZ8MTXP02JQONL.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctctaaactgctcattaactggcatcctacccggcaacgtcccggggtcctgaccgattcgagtggcaggcgggtctgggacagactttcactctcaccatcagcagcctgcaggctagaagagtcgtggtactaggtttactacgtgtactaacgtagttttccgtcggggtccgtttaccgggaccgaaacggggtaccgaaagggtacggaaaacgtacgaaaacggtaacgtggtacggacgttcggacctaaccgaacgttacccttacggtttccttaccgtaactttccccgttaaccccgtaccctaacgttacccgtaaggtaaacggtaaccggttaacttaacccgg

SEQ ID NO: 308324 - DNA, 511 bp, Homo sapiens
  misc_feature: GZ8MTXP02IXQIT.9.12.B01.1.454.CMB.2.raw
  modified_base (244)..(244): a, c, t, g, unknown or other
  misc_feature (244)..(244): n is a, c, g, or t
  modified_base (317)..(317): a, c, t, g, unknown or other
  misc_feature (317)..(317): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggatcagcagaaaccaggacagcctctaaactgctcattaacnggcatctaccccgcatccgggtcctgaccgatcgagtgcagcgggtctgggacagattcactctcaccatcagcagcctgcagctagagntgngctagtttatctgtacaactagttttcacgggtcgttcggacgaaacgggacctaaggtacggaaacttacgaaaacgactaggtacggctacgcaaccta

SEQ ID NO: 308325 - DNA, 524 bp, Homo sapiens
  misc_feature: GZ8MTXP02J0SSK.9.12.B01.1.454.CMB.2.raw
  modified_base (464)..(464): a, c, t, g, unknown or other
  misc_feature (464)..(464): n is a, c, g, or t
tcagtgatacgtctcacgaccggtgctcgatttagtagtgtagattccgcggggagctctgggagaggagcccagcactgggattccgaggtgtttccattcattgatctgcactgaacacagaggactcgccatggagtttgggctgagctggtttcctgttgctatttaaagtgtcagtgtgaggtgcagctggtggagtctgggggaggcttggtccagccgtgggggtccctgaaactctcctgtgcagcctctggatacaccgtcagtagtaactccatgaactgggtccgccaggctccgagggaaggggctgggagtgggtctcagttatttatagcggtggtaacacatactacgcagactccgtgaaagggcagattcaccatctccagagacaattccaggaacacgctgtaatcttacaaaatgaaacagacctgagagtcgagggacacggntagtatactactgtgagagagagtgtgtaacgtcttagtatagtcgtacggacggaacgg

SEQ ID NO: 308326 - DNA, 495 bp, Homo sapiens
  misc_feature: GZ8MTXP02IUNDN.9.12.B01.1.454.CMB.2.raw
  modified_base (438)..(438): a, c, t, g, unknown or other
  misc_feature (438)..(438): n is a, c, g, or t
tcagtgatacgtctcacgaccggtgctcgatttagtagtgtagattccgcgggattgtgaagtgagctacaacaggcaggcagggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactactagcttggtatcagcagaaaccaggacagcctctaaactgctcattaactggcatctaccccggcaatccggggtcctgaccgattcagtggcagcgggtctgggacagattcactctcaccatcagcagcctgcaggctgaagatgtgctagtttatactgtcaatgtttcncgggcttcggcaaagggacaaggtacgaaatcaaaacgactagtcggctcgcaccta

SEQ ID NO: 308327 - DNA, 552 bp, Homo sapiens
  misc_feature: GZ8MTXP02I2CER.9.12.B01.1.454.CMB.2.raw
  modified_base (459)..(459): a, c, t, g, unknown or other
  misc_feature (459)..(459): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaaggggcgtggaggtgggtctcgtagtttatttatagcggtaggtaaccacatactacgcagactccgtgaagggcagattcaccatcctccagagaactaattcccaaggaaccacgctgtactcttacaaaatgaaacngcctagagagtcgaaggacacggctagtatacgttacngtagcgaagngatgtntaacgtntttagattacgtcgtaggggaccaagggtaac

SEQ ID NO: 308328 - DNA, 551 bp, Homo sapiens
  misc_feature: GZ8MTXP02H0VC7.9.12.B01.1.454.CMB.2.raw
  modified_base (244)..(244): a, c, t, g, unknown or other
  misc_feature (244)..(244): n is a, c, g, or t
  modified_base (378)..(378): a, c, t, g, unknown or other
  misc_feature (378)..(378): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttanacggctccgacaacaagaactactagcttggtatcagcaagaaaccaggacacgcctacctaaaactgctcattaactgggcatctacccccggcaacgtccggggtccctgaccgattcgagtgcagcggtcngggacagattcactctcaccatcagcagcctgcaggctagaagactggtgactaagtttattacgtgtactaacgtagttttcgtacgggtcgtttcggaccgaaacggggacctaaacgggtaggaaaactacgaaaacgaacgtacgtacggtactacggacaaccctacg

SEQ ID NO: 308329 - DNA, 586 bp, Homo sapiens
  misc_feature: GZ8MTXP02I5MT0.9.12.B01.1.454.CMB.2.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccacatcaactgcaagtccagccagagtgtttanacggctccgacaacaagaactactagcttggtatcagcagaaaccaggacagcctactaaactgctcattaacnggcatcctaccccggcaacgtccggggccctgacccgtattcgagtcggcagcgggtctggggacagtntttcactctcaccatccagcagcctgacaggctaggaaagtgtggtaggacctaggtttaattaccgtagttacctaaacgttacgttttccgtcggggtaccgtttaccgggaccgttaaacgggacccgtaaagggtacggtaaaacgttaaccgaaaacgtaacgttaggtacggtactacggaccgtaaccctaacg

SEQ ID NO: 308330 - DNA, 547 bp, Homo sapiens
  misc_feature: GZ8MTXP02I5GMM.9.12.B01.1.454.CMB.2.raw
  modified_base (358)..(358): a, c, t, g, unknown or other
  misc_feature (358)..(358): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactggcatctacccggcaactccggggtccctgaccgattcagtggcagcgggtctgggacagatttcactctcnccatcagcagcctgcaggctagaagatgtgctagtttattactgtacaactagttttcgtcgggtcgtttcggaccgaaggggacccaaagggtggaaaacgtacgaaaacggtactaggtaggctacgacaacctactactcgttctactacttcccttcccgcctactctagaacgtacgtactacg

SEQ ID NO: 308331 - DNA, 542 bp, Homo sapiens
  misc_feature: GZ8MTXP02HY5A3.9.12.B01.1.454.CMB.2.raw
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtctgggggaggcttggtccagcctgggggtccctgaaactctcctgtgcagcctctggatacaccgtcagtagtaactccatgaactgggtccgccaggctcccaggggaaggggctggagtgggtctcagttatttatagcggtggtaacacatactacgcagactccgtgaggggcagattcaccatctccagagacaattccaggaacacgctgtatcttacaaatgaaacagcctagagagtcgaggacacggctgtatattactgtcgcgagagagtgtgtacgtcttttaggaattagtacgttgggggacccaaagggggactaaagttcggg

SEQ ID NO: 308332 - DNA, 535 bp, Homo sapiens
  misc_feature: GZ8MTXP02FLIAO.9.12.B01.1.454.CMB.2.raw
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggctccgaggggaagggctggagtggggtctcgagtttatttatagcggtggtaaccacatactacgcagactccgtgaaggcagatcacatcncaganacatccaggacacgctgtatcttacaaatgaaacngcctagaagagtcgagacacggtntagtatattacgngtgacgagagtacgtgtacgtacttgtttagactacgtcggtacgggacgaaggtac

SEQ ID NO: 308333 - DNA, 543 bp, Homo sapiens
  misc_feature: GZ8MTXP02IRZBF.9.12.B01.1.454.CMB.2.raw
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggaggcttggtccaggccgtggggggtccctgaaactctcctgtgcagccctctggatacaccgtcagtagtaactccatgaactgggtccgccaggctccgaggggaaggggctggagtgggtctcgagttattatagcggtggtaacacatactacgcagctccgtgaaggcagattcaccatctccagagacaattccagaacacgctgtatacttacaaatcgaacagacctagaagagtacgaggaccgaggacctagtattacttacgtgtgacggagagactgtagtaacgtcttttagattagtcgtaggggaccaaagggg

SEQ ID NO: 308334 - DNA, 549 bp, Homo sapiens
  misc_feature: GZ8MTXP02JAHF8.9.12.B01.1.454.CMB.2.raw
  modified_base (487)..(487): a, c, t, g, unknown or other
  misc_feature (487)..(487): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttcctgttgctatttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaaggggctggagtgggtctcgtagttatttagtaggcggtggtaaaccacaatacctacgccaagacctccggtaggaaggggcaggtaattcacccatcctaccagagacaatccaggaacacgctagtatcttacaaatcgaacagcctagagagtcgaggacacggntagtatatctgtcgagagagatgtagtaacgtctttagattagtcgtacggggaccaaaggg

SEQ ID NO: 308335 - DNA, 528 bp, Homo sapiens
  misc_feature: GZ8MTXP02HVJVZ.9.12.B01.1.454.CMB.2.raw
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgttttanacggctccgacaacaagaactacttagcttggtatcagcagaaaccaggacagccctctaaactgctcattaaacngggcatcctacccccggcaacgtccggggtccctgaccgattcagtgcagcgggtctgggacagtattcactctcaccatcancagcctgcaggctagaagatgnggtcagtttattactgtacaaagtgtttcgcgggtcgttcggacaaaggggtaccaggggtagtaaacacgaaacgtaacgtcggtagctacgactacctacg

SEQ ID NO: 308336 - DNA, 574 bp, Homo sapiens
  misc_feature: GZ8MTXP02JDL7E.9.12.B01.1.454.CMB.2.raw
  modified_base (244)..(244): a, c, t, g, unknown or other
  misc_feature (244)..(244): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactactagcttggatcagcagaaaccaggacagacctacctaaactgactacattaactgggcatcctacccccggcaacgtccggggtccctgaccgattccgagtcggctagcgggtactgggactagatttcactctcaccatcagcacgctgcgaggctagaagatggtgtctagtttatactgtactaaacttaggtttctccggggtcgtttacgggaccgtaaaggggtaacccaagggttacggaaacgttaaccgaaaacggtaaacgttcggtacggtacgtacgggtacctaacccgtacg

SEQ ID NO: 308337 - DNA, 532 bp, Homo sapiens
  misc_feature: GZ8MTXP02IT7B0.9.12.B01.1.454.CMB.2.raw
  modified_base (389)..(389): a, c, t, g, unknown or other
  misc_feature (389)..(389): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagcctgggggtccctgaaactctcctgtgcagcctctggatacaccgtcagtagtaactccatgaactgggtccgccaggctccgagggaaggggctggagtgggtctcagttatttagtagcggtggtaacacatactacgcagctccgtgaagggcagntcaccatctcagagacaatccaggaacacgctagtatcttacaaatgaacagcctagagagtcggaggacacggctagtatattactgtcgacgagagtatcgtgtaacggtcttttaggattagtcgtggggtaccaaaggg

SEQ ID NO: 308338 - DNA, 544 bp, Homo sapiens
  misc_feature: GZ8MTXP02H82ED.9.12.B01.1.454.CMB.2.raw
  modified_base (244)..(244): a, c, t, g, unknown or other
  misc_feature (244)..(244): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccaggacagcctctaaaactgctacattaaactgggacatcctaccccggacaacgtcccggggtccctgaccgattcagtggcagccgggtctgggacagtattcactctcaccatcagcagcctgcaggcctagaagatggtggctagtttattactgtacaaacgtgttttcgcgggtcgtttcggaccaaagggtaccgaaaggtacggtaaaacacgtaaaacgaactaggtacggactcggcacctacg

SEQ ID NO: 308339 - DNA, 599 bp, Homo sapiens
  misc_feature: GZ8MTXP02HGKPS.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccagccgtggggggtccctgaaactctcctgtgcagcctctggatacaccgtcagtagtaactccatgaactggtccgccaggctccgaggggaaggggcgtgggagtgggtctcagttatttataggtcggtggtaaccacgatactacgcagactccgtgaaggcagtatcaccatctcagacacaatccaggaacacgctagtattacttacaaatagaaacagcctaggaagaggtacggaaggaaccgacgggtaccttaggtaattaacgtttacgtggttaggaccggaaggtaacgtaacgtggttaggtaacgtcgtttttaggaatttacgtacggttcgggggaacccgtaaagggggtaaacg

SEQ ID NO: 308340 - DNA, 563 bp, Homo sapiens
  misc_feature: GZ8MTXP02ITJ94.9.12.B01.1.454.CMB.2.raw
  modified_base (245)..(245): a, c, t, g, unknown or other
  misc_feature (245)..(245): n is a, c, g, or t
  modified_base (323)..(323): a, c, t, g, unknown or other
  misc_feature (323)..(323): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaacaagaactacttagcttggtatcagcaagaaaccaggacagcctacctaaaactgctcattaacnggcatcctacccccggcaacgtccggggtccctgaccgattcgagtggcagcgggtctgggacagtatttcactctcacatcagcagcctgcaggctagaagatggtgctagtttacttacgtgtacaaactgtttacgtcggggtcgtttccggaccgaaacggggtaaccgaagggtaacggtaaacgtaaccgtaaaacgtaaccgtaggtacggtacgtacgtaccaacccgtacg

SEQ ID NO: 308341 - DNA, 538 bp, Homo sapiens
  misc_feature: GZ8MTXP02F0GTF.9.12.B01.1.454.CMB.2.raw
  modified_base (244)..(244): a, c, t, g, unknown or other
  misc_feature (244)..(244): n is a, c, g, or t
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccaggacagcctactaaaactgctcattaactggcatctacccccggcaacgtccggggtccctgaccgattcagtggcagcgggtntggggacagatttcactctcaccatcagcagcctgcaggctgaagntgtgctagtttatacgtgtacaaactgtttcgcggggtcgttcggaccgtaaagggacccgtaaacgggtaggaaactacgaaaacgtaacgtggtacggctacggaccacctacg

SEQ ID NO: 308342 - DNA, 525 bp, Homo sapiens
  misc_feature: GZ8MTXP02GT3YH.9.12.B01.1.454.CMB.2.raw
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccgaggggaaggggctggagtgggtctcgagttatttatagcggtggtaaccacatactacgcagactccgtgaagggcagatcacatctcagagacaattcccgagaacacgctgtactcttacaaatgaaacagcctagacgagtcgaggacacggctagtanattacngtncgagagatcgtgtacgttnttagatgcgtcgggacgaaggac

SEQ ID NO: 308343 - DNA, 668 bp, Homo sapiens
  misc_feature: GZ8MTXP02I62WN.9.12.B01.1.454.CMB.2.raw
  modified_base (248)..(248): a, c, t, g, unknown or other
  misc_feature (248)..(248): n is a, c, g, or t
  modified_base (334)..(334): a, c, t, g, unknown or other
  misc_feature (334)..(334): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaaccatcaactgacaagtccagccagagttgtttanacggctccgaacaacaaagaactacttagcttggtatcagcaagaaaccaggacagccctacctaaaactgactacaattaaacgngggacaactcctaaccccccggactaaacgtccccggggtaccctcggaacccgtaattccgaaggttcgggaccgaaggggccgggggttacgtacgggggaacctaaagtacttttaccgaactcctaccaacccatcccaaaggccaacgcccctggaccgaagggtcttaaggaaaagtagttgggtacggtaccttaaggtttaattaaccgtggtaacctaaacgttacggtttcgtcggggtcgttacggacccgaaaagggaaccgtaaacgggtaagtaaaactaaccgaaaacgtaacgtaggtaggctacggtaccacctacg

SEQ ID NO: 308344 - DNA, 551 bp, Homo sapiens
  misc_feature: GZ8MTXP02I1D85.9.12.B01.1.454.CMB.2.raw
  modified_base (412)..(412): a, c, t, g, unknown or other
  misc_feature (412)..(412): n is a, c, g, or t
  modified_base (513)..(513): a, c, t, g, unknown or other
  misc_feature (513)..(513): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggaggcttggtccaggccgtggggggtccctgaaactctcctgtgcagcctctggatacaccgtcagtagtaactccatgaactgggtccgccaggctccgaggggaaggggcgtgggaggtggggtctcgtagtttatttagtaggtcggtaggtaaacacatactacgcagactccgtagaggggcagatcacatctcaganacaatccaaggaacacgctagtatacttacaaatagaaacagacctgagaggtacgaaggacacggctagtattatacgtgtagcgagagatgtgtacgtntttagaattatcggtaggggaccaaagggacaagtcgg

SEQ ID NO: 308345 - DNA, 567 bp, Homo sapiens
  misc_feature: GZ8MTXP02IAU2Y.9.12.B01.1.454.CMB.2.raw
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (362)..(362): a, c, t, g, unknown or other
  misc_feature (362)..(362): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagagtgttttanacgctccgacaacaagaactatagctggtatcagcagaaaccnggacagcctactaaaactgactacaataacgtgggcatcctaacccccggcaacgtccgggtcctgaccgtntcgagtggcagcggtcagggacagtattcactctacaccatcagcacgcctgcagctgaaangtgagntaagtttatacttgtactaacgtgtttcgtcgggtaccgtttcggaaccgaaacggggaaccgtaaagggttaaccgggaaaattaccgaaaaacggttaaccgtggttacgggacctacggtaaccacccgtaacg

SEQ ID NO: 308346 - DNA, 544 bp, Homo sapiens
  misc_feature: GZ8MTXP02H4P9E.9.12.B01.1.454.CMB.2.raw
  modified_base (453)..(453): a, c, t, g, unknown or other
  misc_feature (453)..(453): n is a, c, g, or t
  modified_base (492)..(492): a, c, t, g, unknown or other
  misc_feature (492)..(492): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaactctcctgtgcagcctctggatacaccgtcagtagtaactccatgaactgggtcccgcaggctccgaggggaaggggctggagtgggtctcgtagttatttagtaggcggtaggtaaccacatactacgcagactccgtagaaaggcagatcacatcctaccagacgacaaatcccaaggaacacgctgtatctacaaatgaaacngcctagacgagtacgaggacacggactagtataattacnggtgacgtagagtatgtgtacgttgtttagaatcgtcggacgggacaaggac

SEQ ID NO: 308347 - DNA, 535 bp, Homo sapiens
  misc_feature: GZ8MTXP02H195O.9.12.B01.1.454.CMB.2.raw
  modified_base (362)..(362): a, c, t, g, unknown or other
  misc_feature (362)..(362): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaacccaggacagcctcctaaactgctcattaactgggcatcctacccggcaacgtccggggtccctgaccgattcagtggcagcgggtctgggacagatttcactctcnccatcagcagcctgcagctagaagatggtggctagtttattactgtacaactagttttcgtcgggtcgtttcggaccgaaggggaccaaaggtaggaaactacgaaacgaacgtgtagctcgacaccatactgtctctactccttcccgctactcctagaacgtacgtactcg

SEQ ID NO: 308348 - DNA, 524 bp, Homo sapiens
  misc_feature: GZ8MTXP02HR3AC.9.12.B01.1.454.CMB.2.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (435)..(436): a, c, t, g, unknown or other
  misc_feature (435)..(436): n is a, c, g, or t
  modified_base (514)..(514): a, c, t, g, unknown or other
  misc_feature (514)..(514): n is a, c, g, or t
tcagtgatacgtctcacgaccggtgctcgatttagtagtgtagattcggcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtncttataactatgtctcctggtaccaacagcacccaggcaaagtccccaaaactcatgatttangaggtcaataagcgccctcgtggggtccctgatcgcttctcctggctcaagtctggcacgacggtccctccctcgacccgtctctcgggctccaggctgacgagtgaggctgattagtactgcagctcattanncgacgacacctacaatgtcgttacggaacgtcggaccacggtcaccgtcctacggtcacgcccgaagacccaacccgntcgcacttcc

SEQ ID NO: 308349 - DNA, 517 bp, Homo sapiens
  misc_feature: GZ8MTXP02FN8DV.9.12.B01.1.454.CMB.2.raw
  modified_base (413)..(413): a, c, t, g, unknown or other
  misc_feature (413)..(413): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactgggcatctacccggcaatccggggtcctgaccgattcagtgcagcgggtctggggacagatttcactctcaccatcagcagcctgcagctgaagatgtggcagtttatactgtacaactagttttcncgggtcgttcggccgaaggggaccaaggtaggaaatacaaaacgaactagtggactcgctacactctcgtactcattcctccgccatctagaacgacgtatacg

SEQ ID NO: 308350 - DNA, 530 bp, Homo sapiens
  misc_feature: GZ8MTXP02F5C1A.9.12.B01.1.454.CMB.2.raw
  modified_base (504)..(504): a, c, t, g, unknown or other
  misc_feature (504)..(504): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacaccgtcagtagtaactccatgaactggtccgccaggctccgaggggaaggggctgggagtggggtctctagttatttatagcggtggtaacacatactacgcagctccgtgaagggcagattcaccatctcagagacaattccaggaacacgctagtatcttacaaattgaacagacctagagagtcgaggacacggctagtatattactagtgcgagagatgtagtaacgtnttttgatatcgtcgggtacaaagggg

SEQ ID NO: 308351 - DNA, 523 bp, Homo sapiens
  misc_feature: GZ8MTXP02F969B.9.12.B01.1.454.CMB.2.raw
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccagccgtgggggtccctgaactctcctgtgcagcctctggatacaccgtcagtagtaactccatgaactgggtccgccaggctccgaggggaggggctggagtgggtctcagttattatagcggtagtaacanatactacgcagactccggtgaaggcagacttcaccatctccagagaacatcccaaggaacncgctgtatcttacaaatgaacagcctagagagtcgagacacggtntatactatatgngacgagagtgtgtgtacgttctttagattcgtcggtacgggacg

SEQ ID NO: 308352 - DNA, 601 bp, Homo sapiens
  misc_feature: GZ8MTXP02IPC1C.9.12.B01.1.454.CMB.2.raw
  modified_base (445)..(445): a, c, t, g, unknown or other
  misc_feature (445)..(445): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggttttcctgttgctatttaaaggtgtccagtgtgaggtgcagctggtggagtcgtgggggaggcttggtccagccgtggggggtccctggaaactctcctgtgcagcctctggatacaccgtcagtagtaactccatgaactgggtccgccaggctccgaggggaaggggctggagtgggtctcgtagttatttatagcggtaggtaaccacatactacgcagactccgtagaggcagattcacatctaccagagacaattcccgaggaacacgctagtacttaccttaaanaaatacgaaacacgtaccgtaggaacgacgtacggaacggacgacggtattagtaattaacgttacgtggtacgacgtaaaggtacgtacgttacggttacgttacgttcgtttacgttacgttacgttacggtacgggtaccggtaacggtaacg

SEQ ID NO: 308353 - DNA, 527 bp, Homo sapiens
  misc_feature: GZ8MTXP02GS11G.9.12.B01.1.454.CMB.2.raw
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactggcatctacccggcaatccggggtccctgaccgattcagtggcagcggtctgggacagatttcactctcnccatcagcagcctgcagctgaanagtgngctagtttacttactgtcaactagtttcgcgggtcgttcggaccgaagggaccaaagggtagaaactacgaaaacgtacgtagtcggctcgacaccgtactcgtactcctcacttcctccgccactctagaacgacgtatacg

SEQ ID NO: 308354 - DNA, 507 bp, Homo sapiens
  misc_feature: GZ8MTXP02GNQ6L.9.12.B01.1.454.CMB.2.raw
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
tcagtgatacgtctcacgaccggtgctcgatttagtagtgtagattcggcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaagtccccaaatcatgatttangaggtcaataagcggccctctggggtccctgatcgcttctcctggctcaagtctggcacacggcctccctgaccgtctctcgggctccaggctgacgatgaggctgattattactgcagcctanatngcagaccaccanatcgtcgtacggacgtcggacacggtccaccgtcgtacgcacgaaccgaacgacccacccntcncactcg

SEQ ID NO: 308355 - DNA, 604 bp, Homo sapiens
  misc_feature: GZ8MTXP02GXQL4.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtctgggggaggcttggtccagccgtggggggtccctgaaactctcctgtgcagcctctggatacaccgtcagtagtactccatgaacgtcgggtccgccgaggctccgaggggaaggggctggaggtgggtctcgtagtttatttagtagcggtaggtaaccacatactacgcagactccggtagaagggcagacttcaccatcctccagacgacaattccgaaaggaaccacgtctagtactcttaacaaattgaacagccctaggaacgacgtacggaacggacacgggtctaggtaatactttacgtggttagacggtaggaaacgtacgtacggttagttaccgttgtttttagaactttacgtcggtacgggggtacccgaaagggggtaacg

SEQ ID NO: 308356 - DNA, 540 bp, Homo sapiens
  misc_feature: GZ8MTXP02HXXKJ.9.12.B01.1.454.CMB.2.raw
  modified_base (401)..(401): a, c, t, g, unknown or other
  misc_feature (401)..(401): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactggtccgccaggctccgaggggaggggctggagtgggtctctagttatttatagcggtggtaaacacatactacgcagactccgtgagggcagattcacatctccaganacaattccaaggaacacgctgtatcttacaaaatgaaacagcctagagagtcgagacacggctagtatattactgtgcgagagattgtcgtacgtcttttgaattacgtcgtcggggacctaaaggggactaaggtcgg

SEQ ID NO: 308357 - DNA, 520 bp, Homo sapiens
  misc_feature: GZ8MTXP02JR8GH.9.12.B01.1.454.CMB.2.raw
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtctgggggaggcttggtccagcctgggggtccctgaaactctcctgtgcagcctctggatacaccgtcagtagtaactccatgaactgggtccgccagggctccgagggaaggggctgggagtgggtctcagttattatagcggtggtaacacatactacgcagctccgtgaaggggcagattcaccatctccagagacaattccaggaacacgctgtatcttcaaatgaacagcctgacgagtcgaggacacggctgatattactgtgcgagagatgtgtaacgtcttttgatatcgtaggggccaaagggg

SEQ ID NO: 308358 - DNA, 547 bp, Homo sapiens
  misc_feature: GZ8MTXP02JYT6Q.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctctaaactgctcattaactgggcatctacccggcaactccggggtccctgaccgattcagtggcagcgggtctgggacagtatttcactctcaccatcagcagcctgcaggctgaagatgtggctagtttattactgtacaaacgtgttttctcggggtcgtttcggaccgtaaacggggaccaaaggtagggaaaactacgaaaacgaactggtggctacggacaccgatcgtcgttctactacttcctcccgaccatccgtagaaacgtaccgtataccg

SEQ ID NO: 308359 - DNA, 533 bp, Homo sapiens
  misc_feature: GZ8MTXP02I033E.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactggcatctacccggcaatcccggggtccctgaccattcagtggcagcggtctgggacagatttcactctcaccatcagcagcctgcaggctagaagatggtgactagtttattactgtacaactagtttcgtcgggtcgttcgaccgaagggtaccaaaggtaggaaaatacgaaaacgtaacgtggtagctacgacaccatcctagtcttactactcctcccgcctatcctagacgtacgtactacg

SEQ ID NO: 308360 - DNA, 531 bp, Homo sapiens
  misc_feature: GZ8MTXP02JXG25.9.12.B01.1.454.CMB.2.raw
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctctggatacaccgtcagtagtaactccatgaactgggtccgccaggctccgaggggaaggggctggagtgggtctcagttatttatagccggtaggtaacacgatactacgcagactccgtgaagggcagattcaccatctcagagacaatccaggaacagctagtatcttacaaatgaacagcctagagagtcgaggacacgggtctgtaactattactgtgcgagagtatggtaagtacgttctttagatacgtcggtacggacg

SEQ ID NO: 308361 - DNA, 554 bp, Homo sapiens
  misc_feature: GZ8MTXP02J0TKP.9.12.B01.1.454.CMB.2.raw
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaacaagaactacttagcttggatcagcaagaaaccaggacagcctacctaaacngctcattaacnggcagtcctacccccggctaacgtcccggggtccctgacccgtattccgagtggccaggcgggtctgggacagtatttcactctcaccatcagcacgcctagccgaggtcagaagntggtcggntagtttatactgtactaactagtttcgcgggtacgtccggaccgaaggaccgtaaggaacggtaaaataccgaaaacgtaacgtggtcggtacgtacgacctaccgtac

SEQ ID NO: 308362 - DNA, 513 bp, Homo sapiens
  misc_feature: GZ8MTXP02FF8W7.9.12.B01.1.454.CMB.2.raw
  modified_base (396)..(396): a, c, t, g, unknown or other
  misc_feature (396)..(396): n is a, c, g, or t
  modified_base (503)..(503): a, c, t, g, unknown or other
  misc_feature (503)..(503): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttatacggctccgacaacaagaactactagcttggtatcagcaagaaaccaggacagcctcctaaactgctcattaaactgggcatctacccccggcaatccggggtcctgaccgattcagtggcagcgggtctgggacagatttcactctcaccancagcagcctgcaggctgaagatgtgctagtttattactgtcaactagtttctcgggtcgttcggaccaaagggaccaaggtaaggaactacaaaacgaactgtcggntcgacactac

SEQ ID NO: 308363 - DNA, 527 bp, Homo sapiens
  misc_feature: GZ8MTXP02GKE57.9.12.B01.1.454.CMB.2.raw
  modified_base (243)..(243): a, c, t, g, unknown or other
  misc_feature (243)..(243): n is a, c, g, or t
  modified_base (376)..(376): a, c, t, g, unknown or other
  misc_feature (376)..(376): n is a, c, g, or t
  modified_base (455)..(455): a, c, t, g, unknown or other
  misc_feature (455)..(455): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgtttanacggctccgacaacaagaactactagcttggtatcagcagaaaccaggacagcctacctaaactgctcattaaactgggcatctacccccggcaacgtccggggtccctgacccgattcagtggcagcgggtntgggacagatttcactctcaccatcagcagcctgcaggctgaagatggtggctagtttatactgtacaactagttttcncgggtcgttcggaccgaaacgggtaaccgaaggtacggaaatcgaaaacgtactagtcgcgtacgacaccta

SEQ ID NO: 308364 - DNA, 581 bp, Homo sapiens
  misc_feature: GZ8MTXP02GTLJ9.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagtgtttanacggctccgacaacaagaactacttagcttggtatcagcaagaaaccaggacagccctacctaaaactgactcaattaaacgtgggacatcctaccccccggcaacgtcccggggtccctgacccgtattccgagtcggcaggtccggggtctaggggacagtactttccactctcaacccatcgagccagccctgacgaggctagaagatggtgacttagtttatactgtactaacgttgtttccgtcgggtcggttacggaccgtaaacgggaaccgaagggtacgaaaacgttacgaaaacgtaacgtaggtacggctacggacctacttacg

SEQ ID NO: 308365 - DNA, 606 bp, Homo sapiens
  misc_feature: GZ8MTXP02I1ZK9.9.12.B01.1.454.CMB.2.raw
  modified_base (560)..(560): a, c, t, g, unknown or other
  misc_feature (560)..(560): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccaggccgtggggggtccctgaaactctcctgtgcagcctctggatacaccgtcagtagtaactccatgaacgtggtcccgccgaggctccgaggggaaggggcgtgggaggtgggtctcgtagtttatttagtagcggtaggtaaccactataactacgcaagactccggtagaagggcagacttacaccatcctaccgaagacgaacctaaattcccgaaaggaaccacgctagtactctttaacaaatgaaacagcctagaagagtcggaaggacacggcttagtatattacgtggtacgacggaagaagtacgttacggttgttaccggttntttttacggaattacgtccggtacgggggacccgaaaggggtaacc

SEQ ID NO: 308366 - DNA, 570 bp, Homo sapiens
  misc_feature: GZ8MTXP02ITNGD.9.12.B01.1.454.CMB.2.raw
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaacgtggtccgccaggctccgaggggaaggggcgtggaggtggtctcgtagttatttagtaggcggtaggtaaccacatactacgcagactccgtgaagggcagatcacatcncaganacaattccgagacacgctagtatcttacaaatnaaacagcctagagacgtcgaggacgacggctagtaactagttacgtgtaggacgaagtagtagtggttacggtaacggttctttttaggaacttacggtacggtacggggggaccaaaagggggtac

SEQ ID NO: 308367 - DNA, 602 bp, Homo sapiens
  misc_feature: GZ8MTXP02IJOM9.9.12.B01.1.454.CMB.2.raw
  modified_base (251)..(251): a, c, t, g, unknown or other
  misc_feature (251)..(251): n is a, c, g, or t
  modified_base (395)..(395): a, c, t, g, unknown or other
  misc_feature (395)..(395): n is a, c, g, or t
  modified_base (445)..(445): a, c, t, g, unknown or other
  misc_feature (445)..(445): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggcccaccatcaactgacaagtcccagccagagttgttttanacggctccgaacaacaagaactactagcttaggtatcagcaagaaaccaggacacgcctactaaactgactctaagttaactggcatcctacccccggacaacgtcccggggtccctgaccgtattcgagtggcgagcggggtntgggactagtattcactctcacatcagcagcctgacaggtctagaaacgngttggtacggacttaggtttacttactacggttactaaacgttggttttccgtacggggtccgtttaccggaccgttaaaacggggacccgtaaggggttaacggaaaacttaacggaaaacgtacgttacggtcggacttacgacctaaccgtacg

SEQ ID NO: 308368 - DNA, 533 bp, Homo sapiens
  misc_feature: GZ8MTXP02GB4QP.9.12.B01.1.454.CMB.2.raw
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttanacggctccgacaacaagaactacttagcttggtatcagcagaaaccaggacagcctcctaaactgctcattaactggcatctacccggcaatccggggtccctgaccgattcagtggcagcgggtctgggacagattcactctcnccatcagcagcctgcagctgaagatgtggctagtttattactgtacaacgtagttttcgtcgggtcgttcggaccgaagggaccgaagggtagaaatacgaaacgacgtagtggctcgacaccacttcgtctccttcacttcccttcccgacctatcctagaacgtacgtactaccg

SEQ ID NO: 308369 - DNA, 522 bp, Homo sapiens
  misc_feature: GZ8MTXP02I9OQC.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtcccagccagagtgtttatacggctccgacaacaagaactacttagcttggtatcagcagaaaccaggacagcctcctaaactgctcattaactgggcatctaccccgcaatccggggtccctgacccgattcagtggcagcgggtctgggacagatttcactctcaccatcagcagcctgcaggctgagatgtggctagtttatactgtcaaatgttttctcgggtcgttcggccgaaagggaccgaaggtacggaaatacgaaaacgtaactaggtacggactcggacactaac

SEQ ID NO: 308370 - DNA, 527 bp, Homo sapiens
  misc_feature: GZ8MTXP02GAFZY.9.12.B01.1.454.CMB.2.raw
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (486)..(486): a, c, t, g, unknown or other
  misc_feature (486)..(486): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactggtccgccaggctccgagggaaggggctggagtgggtctcagttatttanagcggtggtaaccanatactacgcaagactccgtgaagggcagattcaccatctccagagacaatccaggacagctgatcttacaaatgaaactagcctagagagtcgaggacacggctagtatattactgtgcgagagtntagtgtacgttgtttagatacgtcgtacgggacgaaggtac

SEQ ID NO: 308371 - DNA, 597 bp, Homo sapiens
  misc_feature: GZ8MTXP02H6HOL.9.12.B01.1.454.CMB.2.raw
  modified_base (244)..(244): a, c, t, g, unknown or other
  misc_feature (244)..(244): n is a, c, g, or t
  modified_base (483)..(483): a, c, t, g, unknown or other
  misc_feature (483)..(483): n is a, c, g, or t
  modified_base (565)..(565): a, c, t, g, unknown or other
  misc_feature (565)..(565): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttanacggctccgacaacaagaactacttagcttggtatcagcaagaaaccaggacagcctacctaaaactcgactacaattaaacgtgggactactcctaccccccggactaaacgttcccccggggtcccttaggaacccggtaatttcccgaaggttcgggccagggtccgggggtaccgttggggaaccagtactttcacttcctacaccctatcaagcacgccagcaggctaggaaangtggtggacttaggtttattacgtgtacctaaagttcgtttcgtcgggcgtttcggacctaagggaccgaaggtacggaaanaccgaaacgaacttggacgcgtcgctacctag

SEQ ID NO: 308372 - DNA, 528 bp, Homo sapiens
  misc_feature: GZ8MTXP02HMVCN.9.12.B01.1.454.CMB.2.raw
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggatcagcagaaaccaggacagcctacctaaaactgctcattaacnggcatctacccccggcaagtcccggggtcctgacccgattccagtggcaggcgggtctggggacagtactttcactctacaccatcagcagcctgcaggctagaagatgtgctagtttatactgtacaaagtgtttcgcgggtcgttcggaccgaacgggaccaaggtacggaaactacgaaaacgaactggtcggactcgacactag

SEQ ID NO: 308373 - DNA, 542 bp, Homo sapiens
  misc_feature: GZ8MTXP02G2Q88.9.12.B01.1.454.CMB.2.raw
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
  modified_base (493)..(493): a, c, t, g, unknown or other
  misc_feature (493)..(493): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaacgtgggtccgccaggctccgaggggaaggggctgggaggtgggtctcgtagtttatttagtaggcggtaggtaaacacactactacgcagactccgtagagggcagactcaccatcnccagagacaatcaagacacgctgtactctanaatagaacagcctagagaggtacgaggacacggctagtatattactgtcgcgagngatgtcgtacgtctttagaattagtcgtaggggaccaagggacagtcgg

SEQ ID NO: 308374 - DNA, 613 bp, Homo sapiens
  misc_feature: GZ8MTXP02F83GI.9.12.B01.1.454.CMB.2.raw
  modified_base (371)..(371): a, c, t, g, unknown or other
  misc_feature (371)..(371): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagaggccaccatcaactgcaagtccagccagagtgtttatacggctccgacaacaagaactacttagcttggtatcagcaagaaaccaggacagcctacctaaactgctacattaacgtggcatcctacccggcaacgtcccggggtcctgaccgattcaggtggcaggcgggtctgggacagtattcactctcaccatcancagcctgcaggctagaagatgtggtctagtttacttactgtactaacgtagtttcgtcgggtccgttacggaccgaaagggaccgtaaagggtaggaaacgtacgtaaaacggtaacgtggtagggactacggacctaaccctaagtttccgttacggttccctttaaccgtaccgtttaccccgttcccccgtaccctaacttcccgttaaggtaaaaccggtaaccgtacgtttaacccg

SEQ ID NO: 308375 - DNA, 621 bp, Homo sapiens
  misc_feature: GZ8MTXP02IIUMQ.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcgttggtccagccgtgggggtccctgaactctcctgtgcagcctctggactacaccgtcagtagtaactccatagaacgtcgggtccgccaggcctccgaggggaaggggcgtggaggtgggtctcgtagtttattagtaggcggtaggtaaccacatactacgcacgacgtccgtaggaagggcagtacttacaaccactccctaccgaagaacgaactaacttacccgaaggaaccacgactagtacttacttaacaaaatcgaaacagacctaggagacgtacggaaggacgacggcttagtaatacgtttacgtgtacggacgtaaagaggtacgttggtacgttaaccgttcgtttttagaacgtttacgtcggttacgggggaacctaaaggggaac

SEQ ID NO: 308376 - DNA, 536 bp, Homo sapiens
  misc_feature: GZ8MTXP02JK25E.9.12.B01.1.454.CMB.2.raw
  modified_base (483)..(483): a, c, t, g, unknown or other
  misc_feature (483)..(483): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacaccgtcagtagtaactccatgaactgggtccgccaggcctccgagggaaggggctgggagtgggtctcagttatttagtagtcggtaggtaacacgatactacgcagctcgtagaagggcagatcaccatctaccagagactaattccaggaacacgctagtatcttacaaatcgaacagcctagagagtcgaggacacggctgattatacngtcgagagacgatgtagtcgtcttttagactagtcgtacggggactaaagggg

SEQ ID NO: 308377 - DNA, 532 bp, Homo sapiens
  misc_feature: GZ8MTXP02F8TSX.9.12.B01.1.454.CMB.2.raw
  modified_base (401)..(401): a, c, t, g, unknown or other
  misc_feature (401)..(401): n is a, c, g, or t
  modified_base (451)..(451): a, c, t, g, unknown or other
  misc_feature (451)..(451): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccgaggggaaggggctggagtggggtctcgagttatttatagcggtggtaaccacatactacgcaagactccgtgaagggcagattcacatcncagagacaatccaggacacgctgtatctacaaatgaacagccctggaagngtacgaggacacggctagtatattaactgtgcgtagagtatgtgtacgtctttagattagtcgtggggaccaagggtaacg

SEQ ID NO: 308378 - DNA, 551 bp, Homo sapiens
  misc_feature: GZ8MTXP02JRWO6.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcaagaaaccaggacagcctacctaaactgctcattaactggcactcgtacccggcaacgtcccggggtccctgaccgtattcaggtggcaggcgggtctggggacagtacttcactctcaccatcagcagcctgcaggctagaagagtggtgcttagtttattactgtacaacgttagtttcgtcgggtcggttcggaccgaacgggaaccgtaaggtaggaaactacgaaacgaacgtgtacgcgtcgacaccatctcgtccttactcttcctcccgcctatcgtagacgtacgtactacg

SEQ ID NO: 308379 - DNA, 530 bp, Homo sapiens
  misc_feature: GZ8MTXP02HRFF1.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactgggcatctacccggcaatcccggggtcctgaccgattcagtggcagcgggtctggggacagatttcactctcaccatcagctagcctgtagggctagaagatggtggctagtttattactgttcaaactgtttcgtcgggtcgttcggtaccgaagggaccgaaggtaggaaatacaaaacgaactggtagggctgacaccatcctagtcttcattccttcccgctatctgaagcgtattcacg

SEQ ID NO: 308380 - DNA, 687 bp, Homo sapiens
  misc_feature: GZ8MTXP02HVI4X.9.12.B01.1.454.CMB.2.raw
  modified_base (249)..(249): a, c, t, g, unknown or other
  misc_feature (249)..(249): n is a, c, g, or t
  modified_base (342)..(342): a, c, t, g, unknown or other
  misc_feature (342)..(342): n is a, c, g, or t
  modified_base (436)..(436): a, c, t, g, unknown or other
  misc_feature (436)..(436): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgcaagtccagccagtagttgtttanacggctccgaacaacaagaactacttagcttaggtatcaagacaagaaaccgaggacacgcccctactaaaactcgactactaagttaaacgngggacctacgtaccgtacccccggactaaaccgtcccccggggtaccctggaaccccgtatttccgaggttcggacgacgggccgggggttacnggggaacagtaactttccgactcctacaaccctaatcccgaagccaacggtcccagaccgtacgggactaagggaaaagtgttcgggtacggtacttaagttttaactacgtacgttacctaaacgtttcgttttccggcggggtccgttaccgggaccggtaaacgggtaaccgtaaaggggtacgtaaaacgttaccgaaaaaacggttccgttacggtacgggtaccttaccggactaaccgtttacg

SEQ ID NO: 308381 - DNA, 530 bp, Homo sapiens
  misc_feature: GZ8MTXP02GFBUX.9.12.B01.1.454.CMB.2.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttanacggctccgacaacaagaactacttagcttggtatcagcagaaaccaggacagcctctaaactgctcattaactggcatctacccggcaagtccggggtccctgaccgattcagtggcagcggtctgggacagattcactctcaccatcagcagcctgcagctgaagatgtggctagtttattactgtacaactagttttctcggggtcgttcggcctaaacgggaccaaggtaggaaatacaaaacgatacgtggctcgacacctatctacgtctctactccttaacccgtccacttcgtagaacgtacgtactaccg

SEQ ID NO: 308382 - DNA, 535 bp, Homo sapiens
  misc_feature: GZ8MTXP02GQGW4.9.12.B01.1.454.CMB.2.raw
  modified_base (421)..(421): a, c, t, g, unknown or other
  misc_feature (421)..(421): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggaggcttggtccagccgtgggggtccctgaaactctcctgtgcagcctctggatacaccgtcagtagtaactccatgaactggtccgccaggctccgaggggagggctggagtgggtctcgagtttatttagtagtcggtggtaaccacgatactacgcagactccgtgaaggcagattcaccatcctacagagacaattccagaacncgctgtatcttacaaatgaacagcctagagagtacgaggacacggctagtatattacgtgtgacgagagatgtagtacgtgttttgattagtcgtacggggacctaaggggtac

SEQ ID NO: 308383 - DNA, 533 bp, Homo sapiens
  misc_feature: GZ8MTXP02JKRET.9.12.B01.1.454.CMB.2.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactacttagcttggtatcagcaagaaaccnggacagcctacctaaactgctcaatttaactgggcatctacccccggnaacgtccggggtcctgaccgnttcagtggcagcgggtcngggacagatttcactctcaccatccaagcagcctgcaggctagaagatggtgctaagtttatacgtgtactaacgtgttttcgcgggtcgttcgaccggtaaagggacgaaaggtcggaaaatacgaaaacgacttaggcggactcgacaccta

SEQ ID NO: 308384 - DNA, 558 bp, Homo sapiens
  misc_feature: GZ8MTXP02G8S24.9.12.B01.1.454.CMB.2.raw
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
  modified_base (495)..(495): a, c, t, g, unknown or other
  misc_feature (495)..(495): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcgttggtccagccgtggggggtccctgaaactctcctgtgcagcctctggatacaccgtcagtagtaactccatgaactcggtccgccaggctccgaggggaagggcgtgggaggtgggtctcgtagttatttagtagtcggtagtaaccacatactacgcagactccgtgaagggcagatcacatcncagacacatccgagaacncgctagtactacttacaaatgaacngacctggaacgtagtaccgaggacacggtctagtattacttacgngtgacgagagagttgtcgttacgtcttttagattacgtcggtacggggtaccgaaaggtaacg

SEQ ID NO: 308385 - DNA, 679 bp, Homo sapiens
  misc_feature: GZ8MTXP02FXZZS.9.12.B01.1.454.CMB.2.raw
  modified_base (354)..(354): a, c, t, g, unknown or other
  misc_feature (354)..(354): n is a, c, g, or t
  modified_base (510)..(510): a, c, t, g, unknown or other
  misc_feature (510)..(510): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggcccacatcaactgacaacgtccagccagtagttgtttagaccggctaccgaacaacaagtaactacttagcttaggatcgagacaaacgaaaccgtaggacacgtaccctaacctaaagtcgtacctactaacgtttaaacgngggacctacgtacccgtaccccccggactaaccggtcccggggtaccctaggaacccgttattccggaggtcgggacgacgggtccggggttacgaggggacctaagttacttacccaccgttccaccaacctaacgccgaacgaccgacgaccgngacgaggtacgtaaggaagtgtcggttacgtacgtttagtttactacgtacgttacgtaacgtttcggtttccggtaccgggtacggtaccggaacggtaaacgggtaacggtaacggtaaacgaacgtaaacgaaacgttcgtacggtacgtacacgacctacgtacg

SEQ ID NO: 308386 - DNA, 563 bp, Homo sapiens
  misc_feature: GZ8MTXP02IHM9Z.9.12.B01.1.454.CMB.2.raw
  modified_base (244)..(244): a, c, t, g, unknown or other
  misc_feature (244)..(244): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (432)..(432): a, c, t, g, unknown or other
  misc_feature (432)..(432): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctcgacaacaagaactatagcttggtatcagcagaaaccaggacagcctacctaaactgctcaattaactggacatcctaccccggcaacgtcccggggtccnggaccgnttcgagtggcagccgggtcagggacagtattccactctcaaccatacagcacgcctgaccgaggctaggaaagngttggtggacttagtttacttacgtgtacaacgttagttttccgcggggtctttccgggactaaagggggaccctaagggtacggaaaactccgaaaaacgacgttaggtacggactacgaccgaactacg

SEQ ID NO: 308387 - DNA, 550 bp, Homo sapiens
  misc_feature: GZ8MTXP02HZYMB.9.12.B01.1.454.CMB.2.raw
  modified_base (245)..(245): a, c, t, g, unknown or other
  misc_feature (245)..(245): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgttttanacggctccgacaaacaagaactacttagcttggtatcagcaagaaaccagacagccctacctaaaactcgctacattaaacgtgggcactacctacccccggcaaaccgtcccggggtccctgacccgtnttcaggtgcaggtcgggtctggggacagtattcactctcacatcagcancctgcaggctgaaagngtggtgctagtttacttactgtactaacgtgtttcgtcgggtcgttcgggaccaacgggaaccgaaggtacgaaaactcaaaacggtacgtggtcggactcgacaacctg

SEQ ID NO: 308388 - DNA, 582 bp, Homo sapiens
  misc_feature: GZ8MTXP02G7Z17.9.12.B01.1.454.CMB.2.raw
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagtagtgttttanacggctaccgaacaaacaagaactacttagcttaggtatcagacaagaaaccaggaccagacctacctaaactgctactattaacgnggacactccgtacccgacaacgtcccggggtcctaggacctattcgagtcggcgaggcgggtcagggactagtacttcactctcacatcacgcacgcctgcgaggctagagagtgtagtactagtttacttacgtagtactacgtacgtttcggcgggtacgttacggacgtaacgggaaccgaaggtaagaactaacgaaacgagtagtcgctacgacactacgtcttacgtacctactactccgtaaccgtcacgttacgtacggtaactacgtactacgg

SEQ ID NO: 308389 - DNA, 539 bp, Homo sapiens
  misc_feature: GZ8MTXP02JSWZJ.9.12.B01.1.454.CMB.2.raw
  modified_base (304)..(304): a, c, t, g, unknown or other
  misc_feature (304)..(304): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagcctggggggtccctgaaactctcctgtgcagcctctggatacaccgtcagtagtaactccatgaactgggtccnccaggctccgaggggaaggggctgggagtgggtctcgagttatttataggcggtaggtaacacgatactacgcagactccgtggaagggcagattcaccatctccagagacaattccaggaacacgctagtatacttcaaatgaacagcctgagagtcgaggacaggctgtatattactgtcgcgtagagatggtagtaacgtcttttagactagtcgtcggggacctaaagggg

SEQ ID NO: 308390 - DNA, 655 bp, Homo sapiens
  misc_feature: GZ8MTXP02JKNE1.9.12.B01.1.454.CMB.2.raw
  modified_base (211)..(211): a, c, t, g, unknown or other
  misc_feature (211)..(211): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttanacggctccgacaacaagaactacttagcttggtatcagcagaaaccaggacagcctcctaaactgctcattaactggcatctacccgcaatccggggcctgaccattcagtgcagcgggtctgggacagatttcactctcaccatcagcagcctgcagctgaagatgtggacagtttatactgtactaaacgtagttttccgtacggggtacgtttaccgaaacccgtaaacgggggaaccctaaaaggggttaggaaaaacgttccgaaaaaacgggtaaaacctcgggttaagggcccgttaggaccgaaaccccgtaaaagttacccttagggtttcccgttttaacctaaaccgtttacccctttaaccccccgggcccccgtaaaagtttccccctttaggaaaaccggttaaccccgggtttaaaagtttaacccccg

SEQ ID NO: 308391 - DNA, 536 bp, Homo sapiens
  misc_feature: GZ8MTXP02G4Z5J.9.12.B01.1.454.CMB.2.raw
  modified_base (244)..(244): a, c, t, g, unknown or other
  misc_feature (244)..(244): n is a, c, g, or t
  modified_base (380)..(380): a, c, t, g, unknown or other
  misc_feature (380)..(380): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaaactacttagcttggtatcagcaagaaaccaggacacgcctacctaaaactgctcattaactgggcatctacccccggcaacgtccggggtccctgaccattcagtggcagcgggtcngggacagattcactctcaccatcagcagcctgcaggctgaagatgtggctagtttatactgtactaactagtttcgtcgggtcgttcggaccgaaagggaccgtaaggtacggaaaacgtacgaaaacgaacgtacgtaggactacgaccacgtac

SEQ ID NO: 308392 - DNA, 570 bp, Homo sapiens
  misc_feature: GZ8MTXP02HQ310.9.12.B01.1.454.CMB.2.raw
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (325)..(325): a, c, t, g, unknown or other
  misc_feature (325)..(325): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaaacaagaactacttagcttggtatcagcagaaaccaggacagctcctaaacctancncataactaggcatctaccgacacgtccggtccgtcgacgatcagngcgagcggtcgtcggagagattctactctcaccactacagacacgctcgcagacgtagaagagtgtgtacgtagtttaattactacgtactaactacgtttacgttcggtcggtcgtacgaacggaacgaacggaacggtaaacgtaaacgtaaacgaaacgtaacgtacgtacgtacgacgacactactacgtacttactactacttcccgtacctacctactacgtacgtaacgtaacgtacg

SEQ ID NO: 308393 - DNA, 551 bp, Homo sapiens
  misc_feature: GZ8MTXP02H3T6S.9.12.B01.1.454.CMB.2.raw
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctcagactcctggctgtgtctctgggcgagagggccaccatcaactgcaagtccagccagtagttgttttanacggctccgacaaacaagaactactagcttggtatcagacaagaaaccaggacacgcctacctaaaactgactacaattaacgngggactactcctacccccggacaacgttcccggggccctagaccgtattcgaagtggcagggcgggtctgggacagtacttcactcacaccatcagcagccngcgagcagagngtggtagtattagttactacgtgtactacgttcgttcggtcgggtcgtacgacgaaacggaacgaagtaacgaaactacgaaacgtacgtacgtacgcacgacactcg

SEQ ID NO: 308394 - DNA, 676 bp, Homo sapiens
  misc_feature: GZ8MTXP02FLG0P.9.12.B01.1.454.CMB.2.raw
  modified_base (251)..(251): a, c, t, g, unknown or other
  misc_feature (251)..(251): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacggcccaacatacaactgacaagtccagccagagttgtttanacggctaccgacaaacaagaactactagcttaggtatcagcaagaaaccagacagcctacctaactgctacaattaacgtggactactccgtaaccccccggactaacgtccccggggtaccctacggaacccgttattccgaagggtcggaccgtacggggccggggttaccgtagggggaacctaagtacttttcccaccttcctaccgaaaccctataccgaacgccgaacggccccttgggacccgaagggggtaccttaagggaaaagttagttcggggtaggtacctttaaaggtttttaaactcgttacgtacctaaacgtttcggttttccgacggggtccgttaccggacggaaacgggtaaccgaagggttaacgaactaacgaaaacgtagtcggtacgcgtacgaccacctag

SEQ ID NO: 308395 - DNA, 552 bp, Homo sapiens
  misc_feature: GZ8MTXP02FOLRY.9.12.B01.1.454.CMB.2.raw
  modified_base (245)..(245): a, c, t, g, unknown or other
  misc_feature (245)..(245): n is a, c, g, or t
  modified_base (447)..(447): a, c, t, g, unknown or other
  misc_feature (447)..(447): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgacaacaagaactacttagcttggtatcagcaagaaaccaggacagccctacctaaaactgactcattaaactgggacatcctaacccccgggcaacgtcccggggtaccctggacccgtattccagtcggcaggcgggtctggggacagtactttcactctacacccatcagcacgcctgcaggctagaaagngtgtggctagtttatactgtcaaagttgtttcgcgggtcgttcggacgtaaacgggaccgaacgggtagaactacgaaacgactaggtacggctacgacactacg

SEQ ID NO: 308396 - DNA, 598 bp, Homo sapiens
  misc_feature: GZ8MTXP02HC6W9.9.12.B01.1.454.CMB.2.raw
  modified_base (426)..(426): a, c, t, g, unknown or other
  misc_feature (426)..(426): n is a, c, g, or t
  modified_base (481)..(481): a, c, t, g, unknown or other
  misc_feature (481)..(481): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaagtgtccagtgtgaggtgcagctggtggagtcgtgggggaggcgttggtccaggccgtggggggtccctagaaactctcctgtgcagcctctggactaccaccgtcagtacgtaactccatgaactcgggtccgccaggccgtccgaggggaaggggctggggaggtgggtctcgtagtttaatttagtaggtcggttacggtaaacactatactacgcacgcctccggtagaaggggcagtactcaccntcaccagagacaattaccaaggaacacgtctagtactacttacaaaatgaaaccngaccgtagaagacgtcggaacggacgacggtcttagtaacttagttacgtggtcgaggtagtagagtttcgtcgtaagttcgtttagactagtacggtacgggggaccctaaagggg

SEQ ID NO: 308397 - DNA, 501 bp, Homo sapiens
  misc_feature: GZ8MTXP02HECRX.9.12.B01.1.454.CMB.2.raw
  modified_base (353)..(353): a, c, t, g, unknown or other
  misc_feature (353)..(353): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgccctgctctgtgacactctcctgggagttacccgattggagagggccaccatcaactgcaagtccagccagagtgtttatacggctccgacaacaagaactactagcttggtatcagcagaaaccaggacagcctctaaactgctcataactggcatctacccggcaatccggggtccctgaccgattcagtggcagcgggtctgggacagatttcactctcnccatcagcagcctgccaggctgaagatgtaggcagtttatactgtcaacagttttctcgggcttcgggccaaggggaccaaggtggaaatcaaacgactagtggctcggcacatctcgtcttcatctcccgccatctagacgactatc

SEQ ID NO: 308398 - DNA, 765 bp, Homo sapiens
  misc_feature: GZ8MTXP02GX5V9.9.12.B01.1.454.CMB.2.raw
  modified_base (248)..(248): a, c, t, g, unknown or other
  misc_feature (248)..(248): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggccaccatcaactgacaagtccagccagagttgtttanacggctccgacaacaagaactacttagcttaggtatcagcaagaaaccaggacagccctacctaaaactgacctacattaaacgtgggaccactcctaccccccggactaaacgtccccgggggtaccccctaggaaccccgtaatttccgaaggttcggaccgtagggtccgggggttactagggggaaaccctaggtactttttacccaaccttacccttacaaaccccgtattacccgaacggaccctaacggcccccgttagacccgagggggtacccttagggaaaacggtacgtttggggttacgggtacctttaaagggtttttaactttaacccgttaggtttaccttaaaaccgtttagggtttttacccgtaccgggggttcccggttttacccggggaacccgtaaaacgggggttaaacccgaaagggggttaaacggtaaaacgttaaccggaaaaaccggtaaccgttaggtacggtaaccgttcggaccctaacgttaaccg

SEQ ID NO: 308399 - DNA, 575 bp, Homo sapiens
  misc_feature: GZ8MTXP02JJTMH.9.12.B01.1.454.CMB.2.raw
  modified_base (303)..(303): a, c, t, g, unknown or other
  misc_feature (303)..(303): n is a, c, g, or t
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccagccgtggggggtccctggaaactctcctgtgcagcctctggatacaccgtcagtagtaactccatgaactggtccnccgaggctccgaggggaaggggctggagtgggtctcgagttattatagcggtaggtaaccacatactacgcagactccgtagagggcagattcaccatcctccagacgacaattcccgaaaggtaccacgtctagtactcttacaaatgaacngcctagagagtcgaggacacgggtntagtaatacgttacgtggtagacggtagacgtacgtaggtacgttacgttcgttttagacgttacgttcgggtacggggaaccgtaaagggaac

SEQ ID NO: 308400 - DNA, 580 bp, Homo sapiens
  misc_feature: GZ8MTXP02INRNS.9.12.B01.1.454.CMB.2.raw
  modified_base (247)..(247): a, c, t, g, unknown or other
  misc_feature (247)..(247): n is a, c, g, or t
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacgggacatcgtgatgacccagtctccagactccctggctgtgtctcgtgggcgagacgggccaccatcaactgacaagtccagccagagttgtttanacggctccgacaacaagaactactagcttggatcagcaagaaaccaggacagaccctactaaactgctacattaaacgtggcatcctacccccggataaacgtcccggggtccagacccgattccgaggtcgcagccgggtngggacagtactttcactctacaacctanacacgacacgccngacgagcaaggaagtagtcgtagtacttagtttactacgtacgtaactaacgttcgtttcggtcggtacggtaccggaaccgaaacgggtaacgtaacggtaacgaaacgtaacgaaacgtacgtacggtacgacgtacgtaccgactag

SEQ ID NO: 308401 - DNA, 562 bp, Homo sapiens
  misc_feature: GZ8MTXP02JYVI5.9.12.B01.1.454.CMB.2.raw
  modified_base (360)..(360): a, c, t, g, unknown or other
  misc_feature (360)..(360): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactggcatctacccggcaatccggggtccctgaccgattcgagtggcagcggggtctggggacagatttcactctcnccatcagcagcctgcagctagagtatgtggactagtttattaacgtgtactaactagtttcgtcggggtcgttaccggacgaacggggaccgtaagggtacgaaagttacgaaacgtaacgtggtcgtacgtcgaccacctacgtcttcgtacttctaccttccgtaacccgcctacgtacctagtaaacgtacgtactacg

SEQ ID NO: 308402 - DNA, 525 bp, Homo sapiens
  misc_feature: GZ8MTXP02HXQV4.9.12.B01.1.454.CMB.2.raw
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctcnggatacaccgtcagtagtaactcatgaactggtccncagctccgagggaggggctggaggtgggtctntagttattataggcggtaggtaaccacatactacgcagactccgtagaagggcagatcacatcncaganacatcagacncntntatctanaatananagctagagagngagacgacgntagtatatacgtgtgacgagagtagtggtcgtacgttgtttagagttacgtcggtacgggtacgaacgggacg

SEQ ID NO: 308403 - DNA, 614 bp, Homo sapiens
  misc_feature: GZ8MTXP02I0L7C.9.12.B01.1.454.CMB.2.raw
  modified_base (246)..(246): a, c, t, g, unknown or other
  misc_feature (246)..(246): n is a, c, g, or t
  modified_base (423)..(423): a, c, t, g, unknown or other
  misc_feature (423)..(423): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagttgtttanacggctccgaacaacaagaactacttagcttggtatcagcaagaaaccaggacacgaccctacctaaactcgacctactaatttaaacgtgggaccatccgtacccccgggactaaccggtcccggggtacccctgaccccggtatttcgacggtcggaccaggggccggggtacgnggggactagtatttccactctaccaccatcagcacgcctgacgagctagagtagtgtaggacttagtttactacgttgtactaacgttacgttttcgcgggtccgtttacggaccggtaaacgggaaccggtaagggtaacgtaaacgttaccgaaaacgtacgttaggtacgtcgtacgaccgtaactcg

SEQ ID NO: 308404 - DNA, 522 bp, Homo sapiens
  misc_feature: GZ8MTXP02IOME4.9.12.B01.1.454.CMB.2.raw
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (416)..(417): a, c, t, g, unknown or other
  misc_feature (416)..(417): n is a, c, g, or t
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagtgtttanacggctccgacaacaaagaactacttagcttggtaatcagcaagaaaccaggacagacctctaaaactgctnaataaactggcaatctacccccggcaaatccggggtccctgacccgtaattcgagtgcgagcggggtctggggacagattcactctcaccatccagnagcnnagngagagatgtgntagttattactgtactactagttcgtcggtcgtcgacgaacggaacgaacgtaacgaacgtaacaacgaacgtacgtacgacgcgacacac

SEQ ID NO: 308405 - DNA, 535 bp, Homo sapiens
  misc_feature: GZ8MTXP02F38WK.9.12.B01.1.454.CMB.2.raw
  modified_base (319)..(319): a, c, t, g, unknown or other
  misc_feature (319)..(319): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactactagcttggtatcagcagaaaccaggacagcctcctaaactgctcattaaacngggcatctacccccggcaatccggggtccctgaccgattccagtggcagcgggtctggggacagatttcactctcaccatcagcagcctgcaggctgaagatgtgcagtttatactgtcaactagtttctcgggtcgttcggaccgtaaacgggacctaaagggtacggaaaagttaccgaaaacgtaacgtagtacggcgtacgaccgactaacg

SEQ ID NO: 308406 - DNA, 559 bp, Homo sapiens
  misc_feature: GZ8MTXP02I2BBZ.9.12.B01.1.454.CMB.2.raw
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtggggggtccctgaaactctcctgtgcagcctctggatacaccgtcagtagtaactccatgaactcgggtccgccaggctccgaggggaaggggctggaggtgggtctctagtttatttagtagcggtaggtaaccacatactacgcagactccgtgaagggcagattcacatctcagagacaattccaagacncgctgactcttanaaatgaacngcctagagagtcgaggacacggctagtatattacgtgtgcggtaagagtagttaggtcgtaacgttgttttagaatttacgtcggttacgggggacctaaaagggggtaacc

SEQ ID NO: 308407 - DNA, 594 bp, Homo sapiens
  misc_feature: GZ8MTXP02GQXWM.9.12.B01.1.454.CMB.2.raw
  modified_base (550)..(550): a, c, t, g, unknown or other
  misc_feature (550)..(550): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggtcgttggtccagccggtgggggtccctagaaactctcctgtgcagcctcgtggataccaccgtcagtagtaactccatagaacgtcggtcccgccgaggcctaccgaggggaagggcgtgggaggtgggtctcgtagtttatttaagtaggcggtaggtaaacacatactacgacacgactccgtaggacgggcagtacttcaccatcctaccaagacgaactaacttaccgaaggaaacacgctagtactactacaaatagaaacagacctagagagtacggaacgacgacgtacgtagtactattacgtgtacgagagagtatgtgtaccgtntttagaagttactcggtacggggaccaaaggtacgaagttacgg

SEQ ID NO: 308408 - DNA, 582 bp, Homo sapiens
  misc_feature: GZ8MTXP02HMM4C.9.12.B01.1.454.CMB.2.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccgtgggggtccctgaaactctcctgtgcagcctctggatacaccgtcagtagtaactccatgaactgggtccgccaggctccgaggggaaggggcgtgggaggtgggtctcgtagtttatttagtaggcggtagtaaccacatactacgcagactccgtgaaggcagatcacatcncaganacaatcccgaggaacacgtctagtatcttaacaaattcgaaactagacctaggaagacgtacggaaggaccacgggtcttagtattaattacgtgtagacgaaggagtagtggttagtaaccgttgtttttagaattacgtacggtacggggaaccctaaaggggtaacc

SEQ ID NO: 308409 - DNA, 543 bp, Homo sapiens
  misc_feature: GZ8MTXP02IBDHD.9.12.B01.1.454.CMB.2.raw
  modified_base (302)..(302): a, c, t, g, unknown or other
  misc_feature (302)..(302): n is a, c, g, or t
  modified_base (403)..(403): a, c, t, g, unknown or other
  misc_feature (403)..(403): n is a, c, g, or t
  modified_base (450)..(450): a, c, t, g, unknown or other
  misc_feature (450)..(450): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
  modified_base (512)..(512): a, c, t, g, unknown or other
  misc_feature (512)..(512): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttcctgttgctattttaaaaggtgtccagtgtgaggtgcagctggtggagtctgggggaggcttggtccagccgtggggggtccctgaaactctcctgtgcagcctctggatacaccgtcagtagtaactccatgaactgggtccnccaggctccgaggggaagggctggagtgggtctctagttatttatagcggtggtaaccacgatactacgcagactccggtagaagggcagattcaccatcnccagagacaattcccaggaacacgctagtatcttacgaaatgaaacngccctagagagtcgaaggacacggtntagtatacttactgngacgagagtgtgtacgtagtnttgtacgtacgtacgtacggacgaacggacg

SEQ ID NO: 308410 - DNA, 600 bp, Homo sapiens
  misc_feature: GZ8MTXP02GKON1.9.12.B01.1.454.CMB.2.raw
  modified_base (250)..(250): a, c, t, g, unknown or other
  misc_feature (250)..(250): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcgtggtttctgtgctatttaaagtgtcagtgtgaggtgcagctggtggagtcgtgggggaggcttggtccagccgtgggggtcctgaactctcctgtgcngcctcgtggactacaccgtcagtagtaactcatgacgtggtccgcgagctaccggagggaggtcgtgggagtgggtctcgtagtttagttacgtaggtcggtaggtaaccagtactaacgtacgcaacgtacgtccgtaggaaacgggccagtacttacacctancctaaccgagacaaactacttacccgaggaaaccncgtacttagtacttactaaanaaanaacgaacgacgacgtagacgacggacggacgacgacgtacgtagttattacgttacgtagtacgagagtagtacgtagtagttaacgttacgttagtacgtacgtacggtacggtacggtaacgg

SEQ ID NO: 308411 - DNA, 543 bp, Homo sapiens
  misc_feature: GZ8MTXP02GUD5I.9.12.B01.1.454.CMB.2.raw
  modified_base (433)..(433): a, c, t, g, unknown or other
  misc_feature (433)..(433): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaggggcgtggaggtgggtctcgtagtttatttagtagccggtaggtaaacactatactacgcagactccgtagaaggcagatcaccatcacagagacaatccaaggaacacgntagtatctacaaatgaacagcctagagagtcgaacgacgacggctagttaatattacgtgtagcgagatatggtcgtaacgtcttttagattacgtccgtaggggaaccg

SEQ ID NO: 308412 - DNA, 559 bp, Homo sapiens
  misc_feature: GZ8MTXP02FVSVM.9.12.B01.1.454.CMB.2.raw
  modified_base (447)..(447): a, c, t, g, unknown or other
  misc_feature (447)..(447): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttataccggctccgacaacaagaactacttagcttggtatcagcaagaaaccaggacagcctacctaaactgctacaattaacgtgggctatccgtaaccccggcaacgtcccggggtcctcgaccgtattcgaggtcggcaggcgggtctcggggacagtatttccactcctcaccatcaagccagcctagcgaggctagaagagtgtgactagtttatacgtgtactattagtttcgngggtcgttcgacgaacgggacgaaggtagaatacgaaacgacgtgtgctcgacacacttcgtacttctactaccttcctcccgtactactaccgtagtaacgtactataccg

SEQ ID NO: 308413 - DNA, 660 bp, Homo sapiens
  misc_feature: GZ8MTXP02HL4S1.9.12.B01.1.454.CMB.2.raw
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
  modified_base (564)..(564): a, c, t, g, unknown or other
  misc_feature (564)..(564): n is a, c, g, or t
tcagtgatacgtctcacgaccggtgctcgatttagtagtgtagattccgcggggagctctgggagaggagcccagcactgggattccaaggtgtttccattcagtgatctgcactgaacacagaggactcgccatggagtttgggctgagcttgggttttccttgttgcttaattttaaaaggtgtccagtgtgaggtgcagcgtggtggagtcgtgggggaggcgttggtccagccgtgggggtccctgaactctcctgtgcagcctctggactacaccgtcagtacgtaactccatgaacgtcgggtccgccgacggcctaccggaggggaagggcgtgggaggtcgggtctcgtagttatttagtacggtcggtacggtaaacctacgtaactaactacgacacgtaccgttaccggtaggaaacgggactaaggtacttaccaaccctattccaaccgaagaacgaactaaacgttacgaaggaaaccncggtctagtactacttaaacaaaatcggaaaacngtcccgtaagacgacggcgaaacggactaaccggttntaagtaagtttacgtacggtggacggagtaacgagtacgttagttacgttaacgtttgtttagtacgtacggtacgggaacggggtaacaaacggg

SEQ ID NO: 308414 - DNA, 540 bp, Homo sapiens
  misc_feature: GZ8MTXP02IUV4R.9.12.B01.1.454.CMB.2.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (515)..(515): a, c, t, g, unknown or other
  misc_feature (515)..(515): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggtttccttgttgctatttaaaggtgtccagtgtgaggtgcagctggtggagtcgtgggggaggcttggtccgagccgtggggggtccctagaactctcctgtgcagcctctggatacaccgtcagtagtaactccatgaactggtccnccaggctccgaggggaagggctggagtgggtctcgagttatttanagtcggtaggtaacanataactacgcagctccgtagaaggcagattcaccatctcagagacaattcaggacacgctagatcttacaaatgaaacacgcctagacgagtccgagggtacaaggtctagtataacttacgtgtcggacgagagacgtgtagtaacgtttnttagactagtcggtacgggacaagg

SEQ ID NO: 308415 - DNA, 536 bp, Homo sapiens
  misc_feature: GZ8MTXP02F2RHA.9.12.B01.1.454.CMB.2.raw
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
  modified_base (499)..(499): a, c, t, g, unknown or other
  misc_feature (499)..(499): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacaccgtcagtagtaactccatgaactgggtccgccaggctccgaggggaaggggctggagtgggtctctagttatttatagcggtggtaacacactactacgcagactccgtgaggggcagattcaccatctccaganacatccaggaacacgctgtaactcttacaaatgaaacngcctagagagtcgagacacggctgatatactgtgcgagagtattggtacgttacgttntttagaagttacgtcggacgggacaagggactagtcg

SEQ ID NO: 308416 - DNA, 578 bp, Homo sapiens
  misc_feature: GZ8MTXP02JGQPK.9.12.B01.1.454.CMB.2.raw
  modified_base (257)..(257): a, c, t, g, unknown or other
  misc_feature (257)..(257): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtggtttctgtagctatttaaagtgtcagtgtgaggtgcagctggtggagtctgggggaggcttggtccagccgtggggggtccctgaaactctcctgtgcagcctntggatacaccgtcagtagtaactccatgaactggtaccgccaggctccgaggggaagggctggaggtgggtactcgtagtttactttagtaggcgggttaggtaaaccacctattaaccgacggacaagtactccggtagaaggggcagacttaccaaccatctaccaggacactaatcccgagaacacggtctagtactcttaaanaatanacacgacgtacgagacgacgacgacgacgacgtagtatacgtacgtgtagacgagagtagtacgtagtacgtcgttacgtacgtacgtacgtacggacggaacggtacg

SEQ ID NO: 308417 - DNA, 555 bp, Homo sapiens
  misc_feature: GZ8MTXP02JJTCV.9.12.B01.1.454.CMB.2.raw
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacaccgtcagtagtaactccatgaactggtccgccaggctccgaggggaaggggctggagtgggtctctagttattatagcggtagtaaccacatactacgcagactccgtgaagggcagattcaccatcnccaganacaattcccaaggaacacgctagtactcttacaaattcgaaacagcctaggaagagtacggaaggtacaacgggcttgtaatacttacnggtgacgaggagattggtatacggtnttttaggattacgtcgtcggggaccaaggggtaac

SEQ ID NO: 308418 - DNA, 565 bp, Homo sapiens
  misc_feature: GZ8MTXP02GGE6X.9.12.B01.1.454.CMB.2.raw
  modified_base (441)..(441): a, c, t, g, unknown or other
  misc_feature (441)..(441): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctctggatacaccgtcagtagtaactccatgaactgggtccgccaggctccgaggggaaggggctggagtgggtctcgagtttatttatagcggtaggtaacacgatactacgcagactccgtgaagggcagattcaccatctccagagacaattccagtaacacgctagtatccttaanaaatcgaatgtacagagtagacgagacgacggtactagtaacttacgttacgtggtacgacgaagtagtacgttggtacgttaacgttcgtttagacttacgtcggtacggggaaccgaaaggg

SEQ ID NO: 308419 - DNA, 656 bp, Homo sapiens
  misc_feature: GZ8MTXP02IR5HQ.9.12.B01.1.454.CMB.2.raw
  modified_base (338)..(338): a, c, t, g, unknown or other
  misc_feature (338)..(338): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagtagttgtttagacggctaccgaacaacaagaactacttagcttaggtatcagacaaacgaaaccaggacacgccctacctaaaactgactactaattaacgngggaccaactccgtaaccccccgggactaaaccggtccccggggtaccctacggaacccgttattccgaagggtcggaccgtaggggtcccggggttacgtaggggaaaccagttactttaccaacttcctaccaaccctagtcccaaggccacgtcccgtgacgaggctaaggaagtagtggtacggtataagttttactacctaggtacctaaagttcggtttaccgtcgggtccgttacggaccggaaacgggtaaccgtaagggtaacgtaaagtaaaccgaaacgtaccgtaggtacgactcggaccactacg

SEQ ID NO: 308420 - DNA, 562 bp, Homo sapiens
  misc_feature: GZ8MTXP02GAGB8.9.12.B01.1.454.CMB.2.raw
  modified_base (358)..(358): a, c, t, g, unknown or other
  misc_feature (358)..(358): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgacaacaagaactacttagcttggtatcagcagaaaccaggacagcctcctaaactgctcattaactggcatctacccggcaagtcccggggtccctgaccgattcagtggcagcgggtctgggacagattcactctcnccatcagcagcctgcagctagaagagtgtggactagttttattacgtgtactaaacgttagttttcgtacggggtccgttcggaccgtaaacggggaaccgaaagggtaggaaactacgaaaacgtactaggtgcgtacgaccacctactcttcgtccttactacttcctcccgtacctactacgtagaacgtacgtactaccg

SEQ ID NO: 308421 - DNA, 579 bp, Homo sapiens
  misc_feature: GZ8MTXP02FO875.9.12.B01.1.454.CMB.2.raw
  modified_base (245)..(245): a, c, t, g, unknown or other
  misc_feature (245)..(245): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttanacggctccgactaacaaagaactacttagcttggtatcagcaagaaaccaggacagccctactaaaactgactacaattaacgtgggacaataccgtaccccccggactaaacgtccccggggtaccctaggaacccgtaatttccgaggttcggctaggtcgggtactggggacagtactttcactctacaccatcagcagcctgacaggctagaagtatggtagacttagtttatacctgtacaaacgttgtttcgcgggtcgttacggaccgaaagggttaccaaagggtacgaaatacgaaaacgacgtaggtcggcctggaccactacg

SEQ ID NO: 308422 - DNA, 600 bp, Homo sapiens
  misc_feature: GZ8MTXP02HDR6H.9.12.B01.1.454.CMB.2.raw
  modified_base (247)..(247): a, c, t, g, unknown or other
  misc_feature (247)..(247): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgaggagggccaccatcaactgcaagtccagccagagttgtttanacggctaccgacaacaagaactactagcttaggtatcagcaagaaaccaggacagcctactaaacngctacattaacgnggcatctaccccgcaacgtcccgggtcctgaccgattcagtggcagcgggtntgggacagtattcactcncactatcagcacgccgtgacgacggcagtaagagtggtacggtattaaggtttattaccgtgtacctaacgttacgttttcggtaccggggtcgtttaccgggaccggtaaaacggggaacccggtaaaggggtaacggtaaaacgttaacccggaaaaacggttaacgtacgggtacggtaccgtcggaaccgtaacctaacg

SEQ ID NO: 308423 - DNA, 503 bp, Homo sapiens
  misc_feature: GZ8MTXP02HRJPZ.9.12.B01.1.454.CMB.2.raw
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (351)..(352): a, c, t, g, unknown or other
  misc_feature (351)..(352): n is a, c, g, or t
  modified_base (365)..(367): a, c, t, g, unknown or other
  misc_feature (365)..(367): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctcctaaactgctcataactgggcatctacccggnaactccggggccctgaccgattcagtggcagcggtngggacagattcactcnnccatcagcagccnnngnagagangtgntattatatatanactagttcgtcggtcgtcgacgacgacgaagagaanaacaaacgaacgtagtagcgtacgacacactctctctactactcctccgtcctactactacgtacgtacgtactac

SEQ ID NO: 308424 - DNA, 549 bp, Homo sapiens
  misc_feature: GZ8MTXP02JJW7D.9.12.B01.1.454.CMB.2.raw
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtggggggtccctgaaactctcctgtgcagcctctggatacaccgtcagtagtaactccatgaactgggtccgccaggctccgaggggaaggggctgggagtgggtctcgtagttatttataggcggtggtaacacatactacgcagctccgtgaagggcagattcacatctaccagagacaattccaaggaacacgctagtatactacaaatgaacagcctagagagtcgaggacacggctgtaactattacgtggtacgcgagtacgaattgtagtaacgtgttttagattagtccgtagggggacctaaaagggg

SEQ ID NO: 308425 - DNA, 599 bp, Homo sapiens
  misc_feature: GZ8MTXP02GFTBV.9.12.B01.1.454.CMB.2.raw
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (457)..(457): a, c, t, g, unknown or other
  misc_feature (457)..(457): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagtagtgtttanacggctccgacaacaagactacttagcttggatcagcaagaaaccnggacagcctactaaaactgctcaatttaacngggcatcctacccccggcaacgtccggggtccctagacccgattccgagtggactagggccgggtctaggggaacagtactttcactcctacaccctatcaagccaacgcctgaccaggctaggaacgatgggngacctaggtttacttacgtcgtacctaaagttcgttttcgcggggtcgtttacggaccgaaaggggtaaccgtaagggtaacggaacttaaaccgaaaacggtaccttagggttacggccgtacggacccgtaacgttaacg

SEQ ID NO: 308426 - DNA, 703 bp, Homo sapiens
  misc_feature: GZ8MTXP02JN15B.9.12.B01.1.454.CMB.2.raw
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctggaaactctcctgtgcagcctctggatacacgtcagtagtaactccatgaactggtccgcaggctccgaggggaggcgtggagtgggtctcgtagttatttagtaggtcggtacggtaacacgactacgtacgcgacgacgtccgtaggaaggggcaggtacttcacctagtcctacccgagacgaactaaacgttcccgaacgggaaacctaccggtacttacgttaacttaccgtttaacaaaagttacgaaaacccgtagacccgttaaggaaacgacggtaccgggaagggtaccgaacggggtaccttaacggtaaatttacgttaaaccgttgggtacggtaaccggaacggtaacgtaaacgtttccggttaggttaaaacccgggtttttcgtttttaaacggtacgtttaacggttaccggggttaacgggggtaaaccgtaaaacgggg

SEQ ID NO: 308427 - DNA, 563 bp, Homo sapiens
  misc_feature: GZ8MTXP02HMIOT.9.12.B01.1.454.CMB.2.raw
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactgggtccnccgaggctcgagggagggctggagtgggtctcagttattatagcggtaggtaacacatactacgcagaccgtcgtggaagggcagattcacctanctccagagaacaattcccaaggaaccacgctagtactcttacaaaattgaaacagcctagacgagtacgacggacaccgggtntagtattacgttgtaggngacgagtacgtagttggtaacgttacgttcgtttagacgttacgtcgggttacgggaacg

SEQ ID NO: 308428 - DNA, 761 bp, Homo sapiens
  misc_feature: GZ8MTXP02H7S7S.9.12.B01.1.454.CMB.2.raw
  modified_base (192)..(192): a, c, t, g, unknown or other
  misc_feature (192)..(192): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctggtttccttgttgctattttaaaggtgtcagtgtgaggtncagctggtggagtcgtgggggaggcttggtccagccgtcgggggtcctagaactctctgtgcagcctctggatacaccgtcagtacgtaactccatcgaacgtcgggtccgccaggctaccggaaggggaaggggcgtagggaggttggggtcttacgtaagtttagtttaagtaggtcggttacggtaaacactactaacgttacgacaacggtacctaccgggtaaggaaacgggacctaaggtactttacaaccctaacttcccacccgaagggtaacgtaaaccaaactttacccgaaaacggggtaaaccaacccggttacgttacgttaaacttaaccgttaaacgtaaaacgttacggtaaaaccgtacggtaccggtaagggtaaacggtaacgggtacgggaaacgggtaacggtaaccggttacgttaaggttaaactttaaacgttacggttggtaacgtaacgggtaaggtacgtacgtttacgggttaacggtttaaccgtttcgtttaacggtacgttacggttaccggggtaacggggtaaaccgtaaacgggg

SEQ ID NO: 308429 - DNA, 608 bp, Homo sapiens
  misc_feature: GZ8MTXP02G7LJ3.9.12.B01.1.454.CMB.2.raw
  modified_base (480)..(480): a, c, t, g, unknown or other
  misc_feature (480)..(480): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactggtccgccgaggcctccgaggggaaggggcgtggaggtgggtctcgtagttatttagtaggtcggtacggtaacactatactacgacacgcgtccgtaggaacggcagtactcacctattccaccaagacgactaacttccgaaggaaccacgcttagtacttaccttacaaaatcgaaaccncgtacgtaggacgtacggtacggaggaccgacggtacttagtaattacgttacgtggtacggacgaaggtagtagttcggtacgttaacgttcgtttagacgttacgtcgggtacgggaacgtaaagg

SEQ ID NO: 308430 - DNA, 562 bp, Homo sapiens
  misc_feature: GZ8MTXP02F90CR.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctctaaactgctcattaactggcatctacccggcaagtcccggggtccctgaccgattcagtggcagcgggtctgggacagatttcactctcaccatcagcagcctgcagctgaagatgtgctagtttatactgtacaacgtagttttcctcggggtcgtttcggccgaaacggggaccaaagggtacggaaagtaccaaaacgacgtagtggcttacggcacgtaacttctcgttccttactacttcccgttcccgtaccctacgttctacggtaaacggtaccgttacgttaaccg

SEQ ID NO: 308431 - DNA, 638 bp, Homo sapiens
  misc_feature: GZ8MTXP02JM0CM.9.12.B01.1.454.CMB.2.raw
  modified_base (566)..(566): a, c, t, g, unknown or other
  misc_feature (566)..(566): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaacgtgggtccgccgaggcctccgaggggaaggggcgtggaggtgggtctcgtagtttatttagtaggcggtaggtaacccaactactacgtacgcgaacgaccgttcccggtagggaaacgggtaccagtaactttccaaccctacttccctaccgaagaaacgaactaaactttaccccgaaagggaaacccacggtcttagttaacttacctttaacaaaagttgaaaacctagtcccgtaggaacggagtaccggaagaaccgacggtntaggtaactagttacgtgtgacgagacgattcgtagtacgtttgttagactacgtcggacggacgaaggacg

SEQ ID NO: 308432 - DNA, 540 bp, Homo sapiens
  misc_feature: GZ8MTXP02HGWLY.9.12.B01.1.454.CMB.2.raw
  modified_base (271)..(271): a, c, t, g, unknown or other
  misc_feature (271)..(271): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (463)..(463): a, c, t, g, unknown or other
  misc_feature (463)..(463): n is a, c, g, or t
tcagtgatacgtctcacgaccggtgctcgatttagtagtgtagattccgcggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcccgtgcagcctctggatacnccgtcagtagtaactccatgaactgggtccgccaggctccgagggaaggggcnggagtgggctcagttattatagnggtaggtaacacatactacgcagactcgtgaaagggcagatcacatctccagacgacaattccagaacacgctgtatcttcaaaatgaaacagcctgagagtcgaggacaccggtntagtatatacgtgtcgagaagagtagtcgtacgtacgttctttaagattacgtacggtacgggaccgaacggacaag

SEQ ID NO: 308433 - DNA, 588 bp, Homo sapiens
  misc_feature: GZ8MTXP02FQ12T.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagaggccaccatcaactgcaagtccagccagagttgtttatacggctccgacaacaagaactactagcttggtatcagcaagaaaccaggacagcctacctaaactcgactcaattaacgtgggctaactccgtaaccccccgggactaacgtccccggggtaccccttggaacccgtattccgagggtcgggaccggggtccggggtctggggacagtatttcactctcaccatcagcacgtcctgcgaggctagaaagtgtggtaggacttaagtttacttacgtcgtactaacgttagttttccggcggtcggttcggacgaaacgggaaccgaaggtacgaaactacgaaacgtaagtcggacgactcgactacacttcg

SEQ ID NO: 308434 - DNA, 662 bp, Homo sapiens
  misc_feature: GZ8MTXP02GZUQT.9.12.B01.1.454.CMB.2.raw
  modified_base (252)..(252): a, c, t, g, unknown or other
  misc_feature (252)..(252): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggcccaccatcaactgacaagtccagccagtagttgtttanacggctaccgaacaacaagtaacctacttagcttaggtatcgagacaagaaaccgaggacacgtaccctacctaaactcgactactaattaacgtgggacctacgtccgtaacccccggctaaccggttccccggggtaccctggaacccgtattccgaggtcggcgacggcgggtcgagggactagtactttccactcctacaccatacagtacacgtcctgaccgaggctaggaacgtgttggtacgacgttagtttacttacgtacgtaactaacgtttcgtttccggtacgggggtaccgtttaccgggaaaccgttaaacggggaaaccgtaacggggttaaacggtaaacctaaacggaaaccggtaacgtacggtacggaccgttacgacccgactttaaccg

SEQ ID NO: 308435 - DNA, 742 bp, Homo sapiens
  misc_feature: GZ8MTXP02JZJD1.9.12.B01.1.454.CMB.2.raw
  modified_base (407)..(407): a, c, t, g, unknown or other
  misc_feature (407)..(407): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagcgtggtggagtcgtgggggaggcgttgggtccgaggccggtcggggggtcccctagaaaccttcctccgtgtcgcacgccttcgtggactaccaccgtcaagtacgtaacctccatcgaacgtcggtccgccgacggctaccggaggggacgggcgtgggaggtgggtctacgtagttattagtaggcggtagtaaccatatacgtacncgacacgtcgagaaggacagtactccactactacctaccgaagacgaactaaacgttacccgaaaggaaccctaacgtacttagtaacttaccgttaaacaaaacgttcgaaaaccgtacgtacccgttaagggaacggtaacggttacgggaaaacgggtaccgaaccggggtcctttaaaggtaaacgtttaacgtttaaccggtaggttacggaacgggtaaaggtaacggttacgttacgggtttacggttaaacggtttcgtttttaaggaaacgtttacggtttaacccgggggacgggggtaaaacccggaaaggggttaaaacccgg

SEQ ID NO: 308436 - DNA, 521 bp, Homo sapiens
  misc_feature: GZ8MTXP02GZ711.9.12.B01.1.454.CMB.2.raw
  modified_base (244)..(244): a, c, t, g, unknown or other
  misc_feature (244)..(244): n is a, c, g, or t
  modified_base (373)..(373): a, c, t, g, unknown or other
  misc_feature (373)..(373): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagaactactagcttggtatcagcagaaaccaggacagcctacctaaactgctacattaactggcatctaccccgcaacgtccggggtcctgaccgattcagtcggcagcggtcngggacagatttcactctcaccatcagcagcctgacaggctagaagatgtaggctagtttattaacgtgtactaacgtgtttcgcgggtcgttcggacgtaaggaccaaggtacgaactacgaaacgaacgtgtacggctcgacactac

SEQ ID NO: 308437 - DNA, 606 bp, Homo sapiens
  misc_feature: GZ8MTXP02I9710.9.12.B01.1.454.CMB.2.raw
  modified_base (245)..(245): a, c, t, g, unknown or other
  misc_feature (245)..(245): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (390)..(390): a, c, t, g, unknown or other
  misc_feature (390)..(390): n is a, c, g, or t
  modified_base (447)..(447): a, c, t, g, unknown or other
  misc_feature (447)..(447): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttanacggctccgacaacaagaactacttagcttggtatcagcaagaaaccaggacacgcctacctaaactgactcaatttaacgnggcagtcctacccccggnaacgtcccggggtccctgacccgattccagtcggcacggcgggtntggggacagtatttcactctcacatcagcacgcctacgcgaacggtctaggaaagtnttgggtacggtactaaggtttacttacgttgtactaaacgttagttttccgtacggggtccgttacgggacccgtaaaacgggtaaccgaagggttaacggaaacttaacgaaaaccggtaaagtttcggtacgggtaccttacggaccaccgttaacg

SEQ ID NO: 308438 - DNA, 558 bp, Homo sapiens
  misc_feature: GZ8MTXP02GHOV8.9.12.B01.1.454.CMB.2.raw
  modified_base (405)..(405): a, c, t, g, unknown or other
  misc_feature (405)..(405): n is a, c, g, or t
  modified_base (504)..(504): a, c, t, g, unknown or other
  misc_feature (504)..(504): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacaccgtcagtagtaactccatgaactgggtccgccaggctcccgaggggaacggggctgggaggtggggtctcgagttatttataggcggtggtaacacatactacgcagctccgtagaaggcagattcacatcnccagagacaattccaaggaacacgctagtatcttacaaatgaaacagacctagaagagtacgacggaacacgggctaggtactaacttacgtggtacgngaggagacgttgtagtaacgttctttagattagtcgtaggggaccctaaagggg

SEQ ID NO: 308439 - DNA, 581 bp, Homo sapiens
  misc_feature: GZ8MTXP02IBU3Y.9.12.B01.1.454.CMB.2.raw
  modified_base (400)..(400): a, c, t, g, unknown or other
  misc_feature (400)..(400): n is a, c, g, or t
  modified_base (545)..(545): a, c, t, g, unknown or other
  misc_feature (545)..(545): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccaggccgtggggggtccctggaaactctcctgtgcagcctctggatacacgtcagtagtaactccatgaactggtccgcaggctccgaggggaaggggcgtggagtgggtctcgtagttattagtagcggtaggtaaccacatactacgcagactccgtgaaggcagatcacancctacagagacaattccgaggaaacacgctagtactcttaacaaattacgaaactagacctaggagacgtacggaggaccgacgggcttaggtaataacgtttaacgtggtacgacgtaggaagtacgtagttgtaaccggtttntttagagtacgtcggtacggggaacgtaacggaacg

SEQ ID NO: 308440 - DNA, 714 bp, Homo sapiens
  misc_feature: GZ8MTXP02ITCPF.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagaccccaggtcttcatttctctgttgctctggatctctggtgcctacggggacatcgtgatgacccagtctccagacctccctggctgtgtctcgtgggcgagacggccaccatcaactgacaagtcccagccagtagttgtttacgaccggctaccgaacaaacaagtaactacttagcttaggtatcagacaagaaaccgaggaccacgtccctaacctaaaactcgaccttactaagtttaaaccgtcgggcctaacgttacccgtaaccccccgggacgtaaaccggttcccccgggggtaccctacggtaacccgttattcgtaaggtcggaccgtacggggtccggggttcgtacgggggaactaggttctttacctaccttacctacccgaaaccctacttacccgaacggcccaacgtcccgtggaccgaacggttcaaggaaacgtgttgggtacgtacgttagtttttaacttacgtacggtacctaaaacgtttgttttccggtccggggtcgtttaccgggaacgtaacgggaacggtaagggtaaacgtaaactaacgaaaacggtaacgtggtacggtacgtcgaccgtaactcg

SEQ ID NO: 308441 - DNA, 542 bp, Homo sapiens
  misc_feature: GZ8MTXP02HGUCO.9.12.B01.1.454.CMB.2.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (472)..(472): a, c, t, g, unknown or other
  misc_feature (472)..(472): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccaggccgtgggggtccctgaaactctcctgtgcagcctctggatacaccgtcaagtagtaactccatgaacgtgggtcccgccgaggcctccgaaggggaaggggcgtgggaggtgggtctctagttattagtagcggtaggtaacacatactacgcagactccgtgaaggcagatcacatcncaganacaatccagacacgctgtatcttacaaaatgaaacagcctagaagagcgagactacggntagtaatatacgtgacgacgagagtatcgtagttacgttgtttagactacgtcggacgggacgaaaggac

SEQ ID NO: 308442 - DNA, 560 bp, Homo sapiens
  misc_feature: GZ8MTXP02GYDRX.9.12.B01.1.454.CMB.2.raw
  modified_base (244)..(244): a, c, t, g, unknown or other
  misc_feature (244)..(244): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccaccatcaactgcaagtccagccagagttgtttanacggctccgacaacaagaactactagcttggtatcagcagaaaccaggacagcctactaaactgctcaattaactgggacactcaccccccgggcaaacgtccccggggtaccctggacccgtatttccgagtcggctaggccggggttctaggggaccagatttccacgtctcacccatccagcacgcctgaccagggctagaagatggtaggctaagttttatactgtacaactagtttcgtacggggtcgttcggacgtaacggggacccgaaggacgaaataccaaacgactcggtcgactagacacctacg

SEQ ID NO: 308443 - DNA, 573 bp, Homo sapiens
  misc_feature: GZ8MTXP02JVMVI.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaactctcctgtgcagcctctggatacaccgtcagtagtaactccatgaacgtgggtccgccaggctccgagggaaggggctggagtgggtctcgtagttattatagcggtagtaaccacatactacgcagactccgtagaaggcagattcaccatcctccaagagaactaattacccgaggaaccacggtctagttactacttacaaatgaaacagaccctaggagtacgtcggaaggacgacggcttaggtataacgttactggtgacgtaggagtacgtgtacgttagtcgttttgaatacgtcgtaggggacccaaggggtaacc

SEQ ID NO: 308444 - DNA, 561 bp, Homo sapiens
  misc_feature: GZ8MTXP02I3V0I.9.12.B01.1.454.CMB.2.raw
  modified_base (211)..(211): a, c, t, g, unknown or other
  misc_feature (211)..(211): n is a, c, g, or t
  modified_base (382)..(382): a, c, t, g, unknown or other
  misc_feature (382)..(382): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttanacggctccgacaacaagaactacttagcttggtatcagcagaaaccaggacagcctcctaaactgctcataactggcatctacccggcaacgtcccggggtcctgaccgattcagtggcagcgggtctgggacagatttcactctcaccatcagcagcctgcagctgaagntgtgactagtttatactgtacaataggtttctcgggtcgttcggacccgtaaagggacccgaaagggttaggaaactacgaaaaacggactaggtacggctacggcaaacctcgtcttcgttcttacctacgttcccttaacccgcctaactccgtagaaaacgtacgttacttaaccg

SEQ ID NO: 308445 - DNA, 681 bp, Homo sapiens
  misc_feature: GZ8MTXP02H6W0Q.9.12.B01.1.454.CMB.2.raw
  modified_base (386)..(386): a, c, t, g, unknown or other
  misc_feature (386)..(386): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagttgttttatacggctccgacaacaagaactacttagcttggtatcagcaagaaacccaggacagccctacctaaaactgcctactaattaactgggacactccgtaccccggcaaccgtcccggggccccctggaccgattcgagtcggcgaggcgggtctggggacagtactttcactctcnccatcagcacgcctgcacgctagaagtagtcggtgtacttaaggtttatttaccgtaggttacctaaacgtttacggtttttccggtaccgggggttaccggtttaccggggaacccgggaaacgggggaacccgttaaaagggggttacggaaaaacggttaccgaaaaaccggtaaaccggttggtacgggtaccgttacgaccgtaaccgtacttaccgttcgttaccttacttaacctcccgtttaacccccgctaacgttcgtaacggtaacgtaccgttaactaaccgg

SEQ ID NO: 308446 - DNA, 695 bp, Homo sapiens
  misc_feature: GZ8MTXP02J1HR3.9.12.B01.1.454.CMB.2.raw
  modified_base (540)..(540): a, c, t, g, unknown or other
  misc_feature (540)..(540): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctatttaaaggtgtccagtgtgaggtgcagcgtggtggaggtcgtgggggaggtcgttgggtccgaggtcccggtcgggggggttcccctaggaaaccttcgtcctgtgcacgcctcgtggactaccaccgtcagtacgtaactccatgaacgtgggtcccgccgaggccgtaccggaggggaacggggcgtagggaggtcgggtctagtagtttatttaagtaggtacggtaggtaaaccactatacgtacgacacgaccgtccggtaggaaacggggctagacttccaacctactcctacccaaggaactaactaaacttacccgaaggaaaccaacggtctaacgtacttacttaactaaaagtagaaacngtaccgtagggaagtacgaccggaacggacgaccggtacttaggttaattaacgtttaacgtggtaggacggtaaggtaggtacgtacggttagttaccggtttgttttacggaacgtttaggtacgggtacggggaaccggtaaaaggtaaccg

SEQ ID NO: 308447 - DNA, 730 bp, Homo sapiens
  misc_feature: GZ8MTXP02HV97H.9.12.B01.1.454.CMB.2.raw
  modified_base (416)..(416): a, c, t, g, unknown or other
  misc_feature (416)..(416): n is a, c, g, or t
  modified_base (461)..(461): a, c, t, g, unknown or other
  misc_feature (461)..(461): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggtttccttgttgctatttaaaggtgtccagtgtgaggtgcagctggtggagtcgtgggggaggcttggtccagccgtgggggtcctgaaactctcctgtgcagcctctggatacaccgtcagtacgtaactccatgaacgtggtccgccaggctccgaaggggaaggggcgtgggaggtgggtctcgtagtttatttagtaggacggtaggtaaacacaactactacgcagactccggtagagggcagacttcaccatctccaaganaacaattcccgaaggaaccacgtcctagttaactaccctttaaanaaaagtacgaaaacgtacgaccgtaaggaacggtacgggtaaccgggaaacgggtaaacccgaaccgggttacgtttaaggtttaaactttaaacgtttaaccggttagggtacgggaaacggtaaagggtaacggttaaggtttacgggtttaaccggttaacccggttttacgtttttaagggaaacgtttaccggggttacccgggggtaacggggggaaaaccccgtaaaaagggggttaaacccttaaaacgggtttcccgggg

SEQ ID NO: 308448 - DNA, 538 bp, Homo sapiens
  misc_feature: GZ8MTXP02G13F3.9.12.B01.1.454.CMB.2.raw
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactggtccgccagctccagggaaggggctggagtgggtctcagttattatagcgtggtaacacatactacgcagactccgtgaaggcagattcaaccatctaccaagacgaacaaattcccaggaactacgctgatcttaaanaaanacaacacacagagagacgagacgacgactagtataatactagtagacgagaagagtagtagtagtcgttagtatacgtacgtacggtacgaacggaacg

SEQ ID NO: 308449 - DNA, 768 bp, Homo sapiens
  misc_feature: GZ8MTXP02H1AFA.9.12.B01.1.454.CMB.2.raw
  modified_base (262)..(262): a, c, t, g, unknown or other
  misc_feature (262)..(262): n is a, c, g, or t
tcagtgatacgtctcacgaccggtgctcgatttagtagtgtagattccgcggggctctgggagaggagcccagcactgggattccgaggtgtttccattcagtgatctgcactgaacacagaggactcgccatggagtttgggctgagctgggttttcctgttgctattttaaaggtgtccagtgtgaggtgcagctggtggagtcgtgggggaggcttggtccagccgtgggggtccctgaactctcctgtgcagcctcgnggactacaccgtcagtaacgtaacctccatcgaacgtcgggtccccgaccgaggtccttacccgaggtaggggaacggtcgtagggtacggtcggtccgttagtagtttagttagtacggtcgggtaacgtaacaacgtactaccgtacgaccgaacgtccgtacggtaaggacggtacgtaacgtacgtaaccaacccgtacttacccgaacccggtaaagggaacctaaaacccttacccggttaaacccgaaaaccgggtaaaccgtaccgtacgggtttacgttaaactttacccgtttaaaagaaaccgttaacggaaactacccggttacgtaaggaacgttaacggggacgaaccgggttaacggaacccgggtttagttaaacggttaactttacgtacggtaccggtaacggtacggtaaaggtacggttacgttacggttacggtttaacgtttgtaacggtacgtaccggtacgggtaaccggaaacggtaacgg

SEQ ID NO: 308450 - DNA, 514 bp, Homo sapiens
  misc_feature: GZ8MTXP02FVXS5.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactcctggctgtgtctctgggcgagagggccaccatcaactgcaagtccagccagagtgtttatacggctccgacaacaagaactacttagcttggtatcagcagaaaccaggacagcctctaaactgctcattaactgggcatctacccccggcaactcggggtccctgaccgattcagtgcagcggtctgggacagatttcactctcaccatcagcagcctgcaggctgaagatgtggcagtttattactgtcaaactgtttactcgggtcgtgccgaacgggaccgaacgtacggaaagtacaaacgacgtagtacggctcggaccacgtac

SEQ ID NO: 308451 - DNA, 571 bp, Homo sapiens
  misc_feature: GZ8MTXP02F2SK0.9.12.B01.1.454.CMB.2.raw
  modified_base (247)..(247): a, c, t, g, unknown or other
  misc_feature (247)..(247): n is a, c, g, or t
  modified_base (486)..(486): a, c, t, g, unknown or other
  misc_feature (486)..(486): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgacaagtccagccagagttgtttanacggctccgaacaacaagaactactagcttggtatcagcaagaaaccaggacagccctacctaaaactgctacaattaaacgtgggaccaatcctaaccccccggactaaacgtcccggggtaccctgaacccgattccgagtggcagcgggtctgggacagatttcactctcacccatccagcagcctgacaggctaggaagatggtgacttagtttatactgtaccaaattgtttcncgggtcttcggaccgaaacgggaaccgtaaagggtaagaaacgtaacgaaaacgtaacgtagtacggtactacggaccactaacg

SEQ ID NO: 308452 - DNA, 646 bp, Homo sapiens
  misc_feature: GZ8MTXP02HXNTG.9.12.B01.1.454.CMB.2.raw
  modified_base (356)..(356): a, c, t, g, unknown or other
  misc_feature (356)..(356): n is a, c, g, or t
  modified_base (434)..(434): a, c, t, g, unknown or other
  misc_feature (434)..(434): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtcctgaaactctcctgtgcagccctctggatacaccgtcagtagtaactccatgaactggtccgccaggctccgaggggaaggggctgggaggtggggtctcgtagttaagtttanaggtacggttggtaaacacaatactacgcagtacctccggtagaaaggggccaagtacttacacccactcctacccanaagaccaaattcccgagaacacgctagtatacttactaaattcgaaacaagcccgtagaagtagtacggaaggaacaccgggtactaggttaactaagtttaaccgtggttacggtggaaacgacgggtaaacttgggttcccggttaaacgttcgttttttaacggaactttagttaccgggtttacgggggtaacccgtaaaaacggggg

SEQ ID NO: 308453 - DNA, 630 bp, Homo sapiens
  misc_feature: GZ8MTXP02G8CQL.9.12.B01.1.454.CMB.2.raw
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttcctgttgctattttaaaaggtgtccagtgtgaggtgcagctggtggagtcgtgggggaggtcgttggtccagccggtgggggtccctgaaactctcctgtgcagcctctggactacacgtcagtacgtaactccatgaacgtgggtcccgccgacggcgtaccgaggggaagggcgtggaggtggtctcgtagtttattagtagcggtaggtaaccactaatactacgacagactccgtagaggcagatacaccatcctaccagacgactaatcccgaagaaccncgtacttanactactaaacaaagtacgaactgtacgtaggaagacggtacggaacggtaacgtacggttacgttaagttaaacttacgttaacggtgggtacggacgtaagtaaggttacgttcggttacgtttacgttgtttaagacgttacggtaccggggacggggtaaaccgtaaagggtacg

SEQ ID NO: 308454 - DNA, 548 bp, Homo sapiens
  misc_feature: GZ8MTXP02FWRBP.9.12.B01.1.454.CMB.2.raw
  modified_base (499)..(499): a, c, t, g, unknown or other
  misc_feature (499)..(499): n is a, c, g, or t
  modified_base (523)..(523): a, c, t, g, unknown or other
  misc_feature (523)..(523): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtctgggggaggcttggtccagccgtggggggtccctgaaactctcctgtgcagcctctggatacaccgtcagtagtaactccatgaactgggtccgcgaggcctcgaggggaagggcgtggaggtgggtctcgagtttatttagtagcggtagtaaccacatactacgcagactcgtgaaaggcagattcaccatctccagacgacaattccaaggacacgtctgtatcttacaaattagaactagaccctaggaagagtccgaggaccaacgggcttaggtataactttacnggtagcgtagagatgtgtacgttnttgactcgtgtacggggacaggtac

SEQ ID NO: 308455 - DNA, 597 bp, Homo sapiens
  misc_feature: GZ8MTXP02G9YQ5.9.12.B01.1.454.CMB.2.raw
  modified_base (478)..(478): a, c, t, g, unknown or other
  misc_feature (478)..(478): n is a, c, g, or t
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtggggggaggcttggtccagccgtgggggtccctgaaactctcctgtgcagcctctggataccaccgtcagtagtaactccatgaactcgggtccgccaggctccgaggggaaggggcgtgggaggtgggtctcgtagtttatttagtaggtcggtaggtaaacacaactactacgcacgacctccggtagaggggcaagtacttaccacctatctacccaagacgaactaacttccgaaggaaccacgctagtactcttacaaatcgaaacngacctaggaacgagtacgaacggacgacggnttagtacttattacgngtcgacgagtagtagtggttacgtacgttcttttaggaatacgtccggtaggggaccaagggaccagttcgg

SEQ ID NO: 308456 - DNA, 595 bp, Homo sapiens
  misc_feature: GZ8MTXP02JB3IX.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccagccgtggggggtccctggaaactctcctgtgcagcctctggatacaccgtcagtagtaactccatgaactgggtcccgccgaggctccgaggggaaggggctggagtgggtctcgtagtttatttagtagcggtagtaaccacatactacgcagactccgtagaacgggcagattcaccatctacagacgaacaacttccgaagaacacgtactagtactcgttacaaattgaaacacgacctaggaagacggtacgaagggaccgacgggtctagtaatacgttaacgtggtagacggagacggtagtggttacgttaccgtgtttttagaagtttacgtcggtacggggaccgtaaaggggtaacg

SEQ ID NO: 308457 - DNA, 650 bp, Homo sapiens
  misc_feature: GZ8MTXP02JVH8M.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctgggtggagtcgtgggggaggcgttggtccagccgtggggggtccctgaaactctcctgtgcacgcctctggactacaccgtcagtagtaactccatcgacgtcgggtccgccgacggcctccgaggggaacggggcgtgggaggtggggtctcgtagtttatttagtagtcggtaggtaaccactatactacgcacgactccggtaggaagggcagattaccacctactcctaccgaagacgaactaaacttacccgaaaggaaccacgtactagtacttacgttaacaaaattacggaaacagtccctaggaagacggtacggacggaaccgacgggtcttaggtaattactttacgtggtacggacggtaggaaggtagtcggttacggttaccgttgtttttagaacgtttacggtccgggtacgggggaaccgtaaaggggtaaccg

SEQ ID NO: 308458 - DNA, 589 bp, Homo sapiens
  misc_feature: GZ8MTXP02H9N78.9.12.B01.1.454.CMB.2.raw
  modified_base (320)..(320): a, c, t, g, unknown or other
  misc_feature (320)..(320): n is a, c, g, or t
  modified_base (502)..(502): a, c, t, g, unknown or other
  misc_feature (502)..(502): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactggtccgccaggctccgaggggagggcgnggagtggtctctagtttatttagagcgggtaggtaacacactactacgcagactccgtagagggcagattcaccactctccagacacaattccaaggaacacgctagtactcttacaaaagttgaaaccagccgtagaagacggtaccggaaggaccgacgggtctagttaatagtttacgngtacggacgtagtacgtagttcggtacgttacgtttgttagaagttcggtacgggtacggggaaccgtaaacgggtactaacggtcg

SEQ ID NO: 308459 - DNA, 633 bp, Homo sapiens
  misc_feature: GZ8MTXP02HJOKA.9.12.B01.1.454.CMB.2.raw
  modified_base (263)..(263): a, c, t, g, unknown or other
  misc_feature (263)..(263): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaactctcctgtgcagcctntggactacaccgtcagtagtaactccatcgaactgggtcccgccaggctccgaggggaacggggcgtgggagtgggtctacgtagtttagttataggcggtagtaaccactatactacgcagactccgtagaagggcagtacttcaacctatacctccgaaagaacgaactaaacttcccgaaaggtaaccacggtcttagtaacttcttaacaaaattacgaaactagcctaggaacgtacgtcgggaacggacctaacggcttagtaacttacgttacgtggttacgacgtaagaagtacgttggttacgttaaccggtttgtttacgaacgttacggtacggtacggggaaaccgtaaagggtaacg

SEQ ID NO: 308460 - DNA, 601 bp, Homo sapiens
  misc_feature: GZ8MTXP02FYFFA.9.12.B01.1.454.CMB.2.raw
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtcccagccaggagttgtttatacggctccgacaaacaagaactacttagcttaggtatcagcaagaaaccaggacagcctactaaactgactcattaactggacatcctaccccggacacgtccgggtcctgaccgattcgagtcggcgagcgggtacgtgggacagtactttcactctacaccatcagcacgcctgacgaggacttaggaagtgttagggtacgtaccgttagttttaacttacgtacgttacctaaacgtttcgttttcggacgggttccggttaccggaacggtaacgggaaaccgtaagggtaacgggtaaactaaccgaaaacgtacgtaggtacggacgtacggaccacgttacg

SEQ ID NO: 308461 - DNA, 621 bp, Homo sapiens
  misc_feature: GZ8MTXP02H6H4P.9.12.B01.1.454.CMB.2.raw
  modified_base (349)..(349): a, c, t, g, unknown or other
  misc_feature (349)..(349): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccacatcaactgcaagtccagccagagtgttttatacggctccgacaacaagaactacttagcttggtatcagcagaaaccaggacagcctacctaaactgactacattaacgtggcactccgtacccggcaaacgtcccggggtccctgaccgattcgagtggcaggcggtcnggggacagtacttcactctcacatcagcagcctgcacggctaggaagatggtggtacttagtttattactgtactaaacgtggttttccgtcggggtacggtttacggacgtaaacggggtaaccgaagggttaacgggaaaacttacgaaaacgttaacgtgggtacggtacctaggaccctaaccgtaactccgttcgttacccttcgtaaccttccctttaacccccggactaacgttacctaggtaaaacgtaccggtttaactaccg

SEQ ID NO: 308462 - DNA, 628 bp, Homo sapiens
  misc_feature: GZ8MTXP02JH29C.9.12.B01.1.454.CMB.2.raw
  modified_base (312)..(312): a, c, t, g, unknown or other
  misc_feature (312)..(312): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcgttggtccaggccgtggggggtccctggaaactctcctgtgcagcctctggactacaccgtcagtacgtaactccatgaactgggtcccncgaggctcgaggggaagggcgtggaggtcgggtctcgtagttattagtaggtccggtagtaacacaatactacgcacgtactccggtaggaacggcaagtacttaccacctatccctaccgaagacgaactaatcccgaaaggtaaccacgtacgtattacttcttaaacgaaattcgaaacacgtaccgtaggacgacggtacgaacggaccgaggtcttagttaacttagttaaccgtgggtacgaacggtaggtaaacgtagttcggtaagttacgttcgttttagacttacgtacgggtcggggaaaacccg

SEQ ID NO: 308463 - DNA, 565 bp, Homo sapiens
  misc_feature: GZ8MTXP02GEVVI.9.12.B01.1.454.CMB.2.raw
  modified_base (306)..(306): a, c, t, g, unknown or other
  misc_feature (306)..(306): n is a, c, g, or t
  modified_base (443)..(443): a, c, t, g, unknown or other
  misc_feature (443)..(443): n is a, c, g, or t
  modified_base (542)..(542): a, c, t, g, unknown or other
  misc_feature (542)..(542): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttcctgttgctattttaaaaggtgtccagtgtgaggtgcagctggtggagtcgtgggggaggcttggtccagccgtggggggtccctgaactctcctgtgcagcctctggataccaccgtcagtagtaactccatagaactgggtcccnccaggcctccggaggggaaggggctggagtggggtctcgtagtttattagtagtcggtacggtaacactatactacgacagactccgtagaaggcagattcaccatctaccagacgactaatccgaaggaacacgtntagtattccttacaaatcggaacagcctagaagacgtacgacggacacggtctagttaacttagtactgtagacgagagtagtgtagtaacgttgtttnacttagtcgacgggtacaaaggg

SEQ ID NO: 308464 - DNA, 540 bp, Homo sapiens
  misc_feature: GZ8MTXP02FL17Q.9.12.B01.1.454.CMB.2.raw
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccaggctccgaggggaaggggctgggaggtgggtctcgtagtttatttataggcggtaggtaacacatactacgcagctccgtggaaggcagattcacatctccagagacaattccaggaacacgctagtatcttacaaatgaaacngacctagagagtcgaggacacggntgtatattactgtgacgagagtatgtagtaacgtcttttagacttatcgtaggggccgaaagggg

SEQ ID NO: 308465 - DNA, 654 bp, Homo sapiens
  misc_feature: GZ8MTXP02GQ2KI.9.12.B01.1.454.CMB.2.raw
  modified_base (357)..(357): a, c, t, g, unknown or other
  misc_feature (357)..(357): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatcgacccagtctccagacctcccgtggctgtgtctcgtgggcgaggacgggccaccatacaactgacaacgtccagccagtagttgtttacgacggctaccgaacaaacaagtaactacttagtcgttaggtactacgagacaacgaaaccgacggacacgtaccctacctaaactcgactactaattacgnggaccacggggtaccaccccggactacgtcccggggtcctagacctatcgagtggcgaggtcgggtacgcggactagtacttcactacctacacccatccgacgacgacgtccgagaccagggtacgtaggaagtacgtgggtacgtaacgtttacgtttaacttacgtacgttacttaaacgtttcggtttccggtcgggtaccggttacggaaccggaaacggggtaacgtaacgggtaaacgaaacgttaaacggaaacgtacggtaggttacgacgtaccgacgtaccttacg

SEQ ID NO: 308466 - DNA, 714 bp, Homo sapiens
  misc_feature: GZ8MTXP02JCY34.9.12.B01.1.454.CMB.2.raw
  modified_base (251)..(251): a, c, t, g, unknown or other
  misc_feature (251)..(251): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggcccacatcaactgacaagtccagccagtagttgtttanacggctaccgaacaacaaagaactacttagcttaggtatcagacaacgaaaccaggacacgccctacctaaactgacctacaattaaacgtgggactaactcccgtaaccccccggactaaccggttccccggggtacccctacggaacccgtatttccgaagggtcgggaccgaggggtccggggtacgtacgggggacctaggtactttacaaccttcctaccaaccctatccgaacgtccgaacgtccccgtaggaccgaaacgggtcgttaaggaaaacggtagttcgggttacgggtaacctttaaggttttaactttaccggttacgttaaccgttaaaacgtttcggttttccggtccggggttacggttaccggaaaccggtaaacgggtaaccgtaaaggggtaacgtaaacgtaacgaaaacgtacgttaggtcggacgtcgaactacctaac

SEQ ID NO: 308467 - DNA, 533 bp, Homo sapiens
  misc_feature: GZ8MTXP02GUD0K.9.12.B01.1.454.CMB.2.raw
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactggtccgccaggctccgagggaaggggctggaggtgggtctcgtagttatttagtaggcggtggtaaccatatactacgcagactcgtagaaggcagatcacntcncanagacatcagacagctgtatctacaaatagaacagctagagagtcgaaggacgacggctagtatattacgtgtagcgagagtagtgtacgtacgtgttttgattacgtcgtacggggacgaaggtaacg

SEQ ID NO: 308468 - DNA, 631 bp, Homo sapiens
  misc_feature: GZ8MTXP02IQN1P.9.12.B01.1.454.CMB.2.raw
  modified_base (247)..(247): a, c, t, g, unknown or other
  misc_feature (247)..(247): n is a, c, g, or t
  modified_base (394)..(394): a, c, t, g, unknown or other
  misc_feature (394)..(394): n is a, c, g, or t
  modified_base (443)..(443): a, c, t, g, unknown or other
  misc_feature (443)..(443): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaaactgacaagtccagccagagtgtttanacggctccgaacaacaagaactacttagcttaggatcagcaagaaaccagacagccctactaaactgactcaattaacgcggacatccgtacccccgacaacgtcccggggtccctgacccgtattcgagtcggcgtagccggggtntacggggaacagtactttccaactctacaaccctatcacgcaacgtccncgacgaggactaaggtaagtagtcgggtagtaacttaagttttactacgtacgttaactaacgtttcggtttcggtaccgggttcggttacccgggaaaccggtaaacggggtaaacggtaaacggtaaacggtaaaacgtaaacgtaaacgtaaacggtcggtacggtactacgaccgtaaccgtac

SEQ ID NO: 308469 - DNA, 516 bp, Homo sapiens
  misc_feature: GZ8MTXP02IAIW7.9.12.B01.1.454.CMB.2.raw
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttctgttgctattttaaaggtgtccagtgtgaggtgcagctggtggagtctgggggaggcttggtccaggcctggggggtcccctgaaactctcctgtgcagcctctggatacaccgtcagtagtaactccatgaactggtccgcaggctccgaggggaagggctggagtgggtctctagttattatagcggtagaaccacatactacgcagactccgtgaaggcagatcacntctcagnacatccagaacncgctgtatctacaaatgaacagcctagagtagcgagacacggntgtatagttcagtgacgaganagtgtagtacgttntttagattacgtcggtacgggacgaaggac

SEQ ID NO: 308470 - DNA, 589 bp, Homo sapiens
  misc_feature: GZ8MTXP02GPIQO.9.12.B01.1.454.CMB.2.raw
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctgggtggagtcgtggggggaggcgttggtccaggccgtggggggtccctgaaactctcctgtgcagcctctggatacaccgtcagtagtaactccatgaactgggtccgcaggctccgaggggaaggggctgggagtgggtctactagtttatttataggcggtaggtaaccacaatactacgacagtacctccggtaggaacggggcaaggtacttacaacctataccctccaaagacgaacctaattacccgaacggaacacgcctagtactacttaacaaatacgaacagacctggaagagtacggaggaccacgggctaggtattattacgtgtgacgtagacgagtcgtagtacgtgtttagattagtcgtaggggacaagggtac

SEQ ID NO: 308471 - DNA, 570 bp, Homo sapiens
  misc_feature: GZ8MTXP02J2JJX.9.12.B01.1.454.CMB.2.raw
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
  modified_base (425)..(425): a, c, t, g, unknown or other
  misc_feature (425)..(425): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactcctggctgtgtctcgtgggcgagacgggccaccatcaactgacaagtccagccagtagttgttttancggctaccgacaacaagaactattagcttggatcagcaagaaaccaggacagcctactaaacngctacaattaacgnggacacgtcctacccccggactaacgtcccggggtaccngaccgtattcgagtcggcaggcggtctgggacagtattcactctacacatcagcacgccngacgagtcagagtgtggtgtacttagtttactacgtacgtacgtaacgttcggtttcggtacgggtacggtaccggaacggtaaacgggtacgtaacggtaacgtaaactacggaacgtacgtcggtacgcgtacgacctactcg

SEQ ID NO: 308472 - DNA, 595 bp, Homo sapiens
  misc_feature: GZ8MTXP02JTEL9.9.12.B01.1.454.CMB.2.raw
  modified_base (306)..(306): a, c, t, g, unknown or other
  misc_feature (306)..(306): n is a, c, g, or t
  modified_base (484)..(484): a, c, t, g, unknown or other
  misc_feature (484)..(484): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcgttggtccagccgtggggggtccctgaactctcctgtgcagcctctggactacaccgtcagtacgtaactccatgaacgtcggtccnccgagctccgaggggagggctggagtcgggtctcgtagtttattagtagcggtaggtaaccacatacgtacgcagactccggtagaaggcagacttccaaccgtactcctacccgaaggacaactaacttcccgaaaggaaccacggtcttagtacttactttaacaaattacgaacncgtacctaggagacgtacgaaggtacgacggtcttagtactacgttacgtgtacgacgagagtacgtgttagtacgtgtttagagttacgtggtacgggacgaagggtaac

SEQ ID NO: 308473 - DNA, 628 bp, Homo sapiens
  misc_feature: GZ8MTXP02H1NX9.9.12.B01.1.454.CMB.2.raw
  modified_base (482)..(482): a, c, t, g, unknown or other
  misc_feature (482)..(482): n is a, c, g, or t
  modified_base (515)..(515): a, c, t, g, unknown or other
  misc_feature (515)..(515): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagcgtgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaacgtggtcccgcaggctccgaggggaaggggcgtggaggtgggtctcgtagtttattagtaggtcggtaggtaacccactataaccgacgacgaacggtacttcccggtaggaaaggggccaagtaactttccaaccctaatccctaccaaaggacgaacctaaagttaccccgaaagggtaaaccncgtacttagtattactaactaaaatcgaaacgngacctggaacgagtacgaaggacgacggtcttagtaataactttcgaggttcgacgtaaggatagtgttacgtacgttgtttagagttacgtcggtacggaccgtaaaggacg

SEQ ID NO: 308474 - DNA, 692 bp, Homo sapiens
  misc_feature: GZ8MTXP02FQLGK.9.12.B01.1.454.CMB.2.raw
  modified_base (243)..(243): a, c, t, g, unknown or other
  misc_feature (243)..(243): n is a, c, g, or t
  modified_base (539)..(539): a, c, t, g, unknown or other
  misc_feature (539)..(539): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcagagggccacatcaactgcaagtccagccagagttgtttanacggctaccgacaacaaagactactagtcttaggtatcagacaaagaaaccgaggaacacgtccctaacctaaacgctacctactaatttaaacgcgggactacgttacccgtaacccccggactaaaccggtcccccggggtacccttacggaaccccgttatttaccgacgggttcggaccgtacggggtccgggttacggtacgggaacctaaggtttactttacccgactacctacccaaccggtaagtcccaaaggtcctacggacccgtgaacgacggtctaaggaaagngtttaggcggaacctttaggtttacttacggtacgtaccttaaattcggttttccggacggttccggttacgacggtaaacggtaccgtaaagggtaaccgtaactaacaaaaaccggggttcgtacggtacgacgtacgtacctaacgtacg

SEQ ID NO: 308475 - DNA, 577 bp, Homo sapiens
  misc_feature: GZ8MTXP02IFJKY.9.12.B01.1.454.CMB.2.raw
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
  modified_base (539)..(539): a, c, t, g, unknown or other
  misc_feature (539)..(539): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtcgtgggggaggcttggtccagccgtgggggtccctgaaactctcctgtgcagcctctggatacaccgtcagtagtaactccatgaacgtggtccgccaggctccgaggggaagggctgggaggtgggtctcgtagtttatttagtagcggtaggtaacacactactacgacacgactccgtagaggggcagacttaccaccatctaccagagaactaatccaaggaaaccacgacttagtactacttacgaaatcgaaacngcctagacgtaggtacgaggacncggtctagttaattatacgtagtcggngtaagataagtgtcgttaacgtttnttagaagtacgtcggacggggaactaaggactacgtcg

SEQ ID NO: 308476 - DNA, 638 bp, Homo sapiens
  misc_feature: GZ8MTXP02G5615.9.12.B01.1.454.CMB.2.raw
  modified_base (337)..(337): a, c, t, g, unknown or other
  misc_feature (337)..(337): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcaagaaaccaggacagcctcctaaactgctcattaactggcatctacccggcaatcccggggtcctgaccgattcagtggcagcgggtntgggacagtattcactctcaccatcagcagcctgcgagctagaagatgtggactagtttattactgtactaacgtagttttcgtcgggcgtttcggaccgtaaacggggaaccgtaaagggtaggtaaaactaccgtaaaacggaaaccgttgggtacggaccgttacggaccgtaacccctaaagttacccgttacggtttccgtttacccgtaaaccttttcccgttaaccccccggtaccttaaaccgtttaccgtaaacgggtaaaacggttaaacccggttaacgtttaaaccccg

SEQ ID NO: 308477 - DNA, 536 bp, Homo sapiens
  misc_feature: GZ8MTXP02G9NB7.9.12.B01.1.454.CMB.2.raw
  modified_base (409)..(409): a, c, t, g, unknown or other
  misc_feature (409)..(409): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggacttgccatggagtttgggctgagctgggttttccttgttgctatttaaaaggtgtccagtgtgaggtgcagctggtggagtcgtgggggaggcttggtccagccgtgggggtccctgaaactctcctgtgcagcctctggatacaccgtcagtagtaactccatgaactgggtccgccgaggctccgaggggaaggggctgggagtgggtctctagttattagtagcggtagtaacacatactacgcagactcgtagaagggcagattcacatctcaganacaatccaggaacagctagtatcttacaaaattgaaactaggcctagagacgtcgaagacacggctagtaatacttatgagcgagagtagtgtaagtacgtcttttagatagtccggtagggaaccg

SEQ ID NO: 308478 - DNA, 660 bp, Homo sapiens
  misc_feature: GZ8MTXP02IG193.9.12.B01.1.454.CMB.2.raw
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagcttgggttttccttgttgtcttattttaaaaggtgtccagtgtgagtgcagctggtggagtcgtgggggaggcgttggtccgaggtccggtggggggtccctgaaacctctcctgtgcacgcctctggactacaccgtcagtagtaactccatgaacgtcggtcccgccgacggcgtaccgaaggggaaggggcgtgggaggtgggtctcgtaagtttatttagtaggtccggtagtaaccactatactaacgcagacgtcgtaggaaggcaggacttcaaccctagtccctaccgaagaacgaaacctaacgttacccgaaaggaaacctacggtcttagtaaacttaccttaaacaaaagttacgaaaaccaggtaccctagggaacgtaacggtacggaaagggtaccacgggtacttagttaaattaattacgtgtacggagaaggtaagtgttggtaacgttacgttagttttaagagtttacgtccgggtaacggggaaccg

SEQ ID NO: 308479 - DNA, 617 bp, Homo sapiens
  misc_feature: GZ8MTXP02IX2PI.9.12.B01.1.454.CMB.2.raw
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (483)..(483): a, c, t, g, unknown or other
  misc_feature (483)..(483): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagcgtgggtggagtcgtgggggagcgttggtccaggccgtgggggtccctagaactctcctgtgcagcctctggactacnccgtcagtacgtaactccatggaactcgggtccgccgaggcctccggaggggaacggggcgtggggnggtcggggtctcgtagtttatttagacggtcggtacggtaacactatacgtacgacacgcgtcgaggtaggacagtactcacactcaccagacactaattacccgagaacctgcctatacttctacaaactcggtaaacncgcgtaagacgacgacgacggacgtcggtacttaagttacttacgttacgtaggtacggacgtaaggtacgtacgttcggtttagttaaccgtttgtttaagacgtcggttacgggtacggggaacgtaaaggg

SEQ ID NO: 308480 - DNA, 557 bp, Homo sapiens
  misc_feature: GZ8MTXP02I8Y7D.9.12.B01.1.454.CMB.2.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (321)..(321): a, c, t, g, unknown or other
  misc_feature (321)..(321): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgtttanacggctccganaacaagaactactagcttggatcagcaacgaaaccaggacagcctacctaaactgctcaattaacgngggcatcctaccccccggacaacgttcccggggtaccctggaacccgtattcgagtcgggcacgggtcgggtctaggggacagtattcactctcaccatcagcagctgacaggctagaacgatggtgacgtagtttatacgtgtactaactgttttaccgcggtcgtacggtacgtaacggaaccgtaggtaacgtaaacgtacgaaacgtacgtacgtcgactacggactactac

SEQ ID NO: 308481 - DNA, 636 bp, Homo sapiens
  misc_feature: GZ8MTXP02IQNY8.9.12.B01.1.454.CMB.2.raw
  modified_base (245)..(245): a, c, t, g, unknown or other
  misc_feature (245)..(245): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
tcagtgatacgtctcacgaccggtgctcgatttagtagtgtagattccgcggggattgtgaagtgagctacagcaggcaggcaggggcagcaagatggtgttgcagacccaggtcttcatttctctgttgctctggatctctggtgcctacggggacatcgtgatgacccagtctcagactccctggctgtgtctcgtgggcgagagggccaccatcaactgcaagtccagccagagttgtttanacggctaccgacaaacaaagaactacttagcttggtatcagcaagaaaccaggaacagacctacctaaaangtctactaattaaaccgtggacactcccctaacccggnaacgtcccgggtcctagaccgattcagtggcaggcggtctagggactagtactttcaactctacaccatcagcagccgtagcgaggacttagaagtagttgtaggtacgttaagtttaattaccgtcgttaacgtaaaacgttacggttttaccggttacgggggtccgtttaccgggtaaaccggtaaacgggggaaacccgtaaaacgggtaagggtaaaacgttaaccgaaaaacggtaaaaccggtggtacggggtaccttacggtacctaaacccgg

SEQ ID NO: 308482 - DNA, 547 bp, Homo sapiens
  misc_feature: GZ8MTXP02FODM2.9.12.B01.1.454.CMB.2.raw
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (453)..(453): a, c, t, g, unknown or other
  misc_feature (453)..(453): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtgggggtccctgaaactctcctgtgcagcctctggatacaccgtcagtagtaactccatgaactggtccncaggctccgagggaaggggctggagtgggtctcgtagttatttagtagcggtaggtaacacgatataccccccgnagcctccgtggaagggcagattcaccatctaccagagacaattccaggaacacgctagtatactacaaatgaacngcctagacgagtcgaggacacggctagtatacttactgtgacgagagactgtacgtaacgtcgttttagacttatcgtacgggacctaaagggg

SEQ ID NO: 308483 - DNA, 630 bp, Homo sapiens
  misc_feature: GZ8MTXP02JFJHQ.9.12.B01.1.454.CMB.2.raw
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagttgtttanacggctccgacaacaagaactacttagcttggatcagcaagaaaccaggacagcctacctaaaactgacctacaatttaaacngggactaactccgtaccccccggacaacgttcccccggggtaccctaggacccgtattccgaaggttcgggaccgacggtcggggtcgtacggggacctaagtactttccacgtcctacaccatcaagcacgcctgacagggactaggaaagtgtcggtggacttaaggtttactacgttacgtactaaacgttgtttcgtcggggtccgttacggaacccggtaacgggaaccgtaaggtacggtaaaataccgaaaacggttaacgtggtacggtactacggacccgtaacctacg

SEQ ID NO: 308484 - DNA, 617 bp, Homo sapiens
  misc_feature: GZ8MTXP02HXM2H.9.12.B01.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (324)..(324): a, c, t, g, unknown or other
  misc_feature (324)..(324): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccacatcaactgacaagtccagccagtagtgtttancggctcganaacaagactatagcttggatcagacaagaaacaggacagacctactaaaactgactactattaacgnggacctagtaccctaccccggactaaacgtcccggggtaccctagacccgtatttccgaagttcggcgacggtccggggtccgtagggacctagtactttccacttcctacaaccctatccgaaagccgtacgacccgtgacgtacggacttaggaaagtcgttggtaccggattaaggtttaacttacgtacgttacaaacgttcgtttacggcggtcgttacggacgaaacggaaccgtagggtaacgtaataccgaaaacgtacgtggtacggactacggacctactacg

SEQ ID NO: 308485 - DNA, 591 bp, Homo sapiens
  misc_feature: GZ8MTXP02FQQ6O.9.12.B01.1.454.CMB.2.raw
  modified_base (247)..(247): a, c, t, g, unknown or other
  misc_feature (247)..(247): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtcccagccagagttgtttanacggctccgaacaacaagactactagcttggatcagcaagaaaccaggacagcctacctaaactgctacaattaacgtggactactcgtacccccggcaacgtcccggggtccctggaccctattcaggtcggcagggcggtactggggactagtatttcactctacaccatccagcacgcctgacgagggctagaaagtgtacgggtgtaccgttagtttaactacgtgtacaaacgttgtttccgtcgggtccggttaccggacgaaaacgggtaccgtaaagggttaacgaaacttaaccgaaaacgtaaaccgtggtacgtacgtcgaccgtaacttacg

SEQ ID NO: 308486 - DNA, 647 bp, Homo sapiens
  misc_feature: GZ8MTXP02IP6QA.9.12.B01.1.454.CMB.2.raw
  modified_base (264)..(264): a, c, t, g, unknown or other
  misc_feature (264)..(264): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtggggggtccctgaaactctcctgtgcagcctntggatacaccgtcagtagtaactccatgaactgggtccgccaggctccgaggggaacgggctggagtgggtctcgtagttatttatagcggtggtaaccacatactacgcagactccggtgaacgggcagacttcaacctatcctaccagtaacgaacaaacgtttaccgaagggaaaccacgacttagtaactcttaaccaaattacgaaaaccgtagaccccttaggaagacggttacggaacgggacaacgggcttaggtaacttatttaaaccgtggttagaccggaaaggtacgtaaacgttgggttacgttaacggttccgtttttagggaatttacgttacggtcgggggtaaccccgtaaaagggggtaaacccg

SEQ ID NO: 308487 - DNA, 526 bp, Homo sapiens
  misc_feature: GZ8MTXP02HKLRX.9.12.B01.1.454.CMB.2.raw
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (332)..(332): a, c, t, g, unknown or other
  misc_feature (332)..(332): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacggctccgacaacaagactacttagcttggtatcagcagaaaccaggacagcctctaaactgctnattaacnggcatcacccccggnaacgtccggggtccctgaccgattccgagtggcagcgggtctggggacagtactttcactctcaccatcagcagcctgcaggctagagatgtgctagtttatactgctaatacgtttcgtcgggtacgttcggaccgtaacgggaaccaagggtacggaaatacgaaaccgaagtgtcggactcggaccaccta

SEQ ID NO: 308488 - DNA, 725 bp, Homo sapiens
  misc_feature: GZ8MTXP02GLOFX.9.12.B01.1.454.CMB.2.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagacgggccacatcaactgacaagtccagccagagttgtttanaccggctccgaacaacaagactactagcttaggtatcagcaagaaaccgnggacagaccctactaaactgctacaattaacgngggacactccgtaaccccccgggactaacggtcccggggtaccctacggaacccgttattccgaggttcgggaccgagggtccgggggttacgtacgggggactaacggtacttttacccacttacctaccaacctaactccgaacgaccgaacggacccttgggacccgaaaggtccgttaacgggaagtaagttcggggtacggtaaccttaaggtttttaacctagttacggttaccctaaaacggtttcggttttacccggccgggggttaccggtttacccggggaaacccggaaaacggggtaaacccgggttaaaggggtaaaaccggtaaacgtaaacccgaaaaccggtaacgtcgggttacggacgttacaccgtaccttaacg

SEQ ID NO: 308489 - DNA, 648 bp, Homo sapiens
  misc_feature: GZ8MTXP02GC769.9.12.B01.1.454.CMB.2.raw
  modified_base (249)..(249): a, c, t, g, unknown or other
  misc_feature (249)..(249): n is a, c, g, or t
  modified_base (469)..(469): a, c, t, g, unknown or other
  misc_feature (469)..(469): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacgggccaccatcaactgacaagtccagccagagttgtttanacggctaccgaacaacaaagaactacttagcttggtatcagcaagaaaccaggacagcctacctaaactgactacattaaacgtcgggactactccgtaccccccggactaacgtccccggggtaccctggaacccgtattccgaaggtcgggactacgggccgggtcgtacggggaacctagtactttaccacctactccaaccatcaagcacgtcccngacgacgtacgtaggaagtagtgggtacgtacgttaagtttacttacgtacgtacctaacgttacgttttccgggtccgggttacggttaccgggaaccggtaaacggggtaacgtaaacgggtaacgaaaacgtaaacgtaaaacgtacgtggtacggtaccgtacgacctacgtacg

SEQ ID NO: 308490 - DNA, 728 bp, Homo sapiens
  misc_feature: GZ8MTXP02JSI1J.9.12.B01.1.454.CMB.2.raw
  modified_base (296)..(296): a, c, t, g, unknown or other
  misc_feature (296)..(296): n is a, c, g, or t
tcagtgatacgtctcacgaccggtgctcgatttagtagtgtagattccgcggggtgggagaggagcccagcactgggattccgaggtgtttccattcagtgatctgcactgaacacagaggactcgccatggagtttgggctgagctgggttttcctgttgctattttaaaggtgtccagtgtgaggtgcagctggtggagtcgtgggggagcttggtccaggccgtgggggtccctgaaactctcctgtgcagcctcgtggatacaccgtcagtagtaactcatgaacgtggccncgagctccgagggacggctggagtgggtctcgtagtttatttagaggtcggttacggtaaactacacgtacctacgacagtacctccggtagaggggcaaggtacttaccacctaacttccacccgaaggaaccgtaactaaacgttccgaaaagggaaaccccttaaggtcccgtagttaaacttaccgttaaccaaaaacgttaaaggtaaactaaaccggtacccgtacgtaaggtacgggtaacggtaacggaaccggaaaccggtcccggtacggttaacgtttaacgtttaaactttacggggtacggtacggtaaggtaacggtacggttaacggttacggttacggtttaacgtttacgttaacggttaacggttacgggtacggggtaaccgggtaaacggtaaaccggttaacggttaccgg

SEQ ID NO: 308491 - DNA, 554 bp, Homo sapiens
  misc_feature: GZ8MTXP02JQ82A.9.12.B01.1.454.CMB.2.raw
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (455)..(455): a, c, t, g, unknown or other
  misc_feature (455)..(455): n is a, c, g, or t
tcagtgatacgtctcacgaccggtgctcgatttagtagtgtagattcggcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggtncttataactatcgtctcctggtaccaacagcacccaggcaaacgtccccaaatcaatgatttangagtcaatagcgcctcgtgggtcctgatcgcttcnctgctccagtctggcacncgcctccngaccgtntcctgggacctcgacggtctcggacgtagtgacggtcttagatttattaacttgacagctcatactgccaggaccaacccganaacgtgtacgttacggaaacggtcgggtaccgaacggtctacccggttacgacggtcacgcccgaacggtacccaacccgactcgtacctacgttcccg

SEQ ID NO: 308492 - DNA, 564 bp, Homo sapiens
  misc_feature: GZ8MTXP02GCCRY.9.12.B01.1.454.CMB.2.raw
  modified_base (521)..(521): a, c, t, g, unknown or other
  misc_feature (521)..(521): n is a, c, g, or t
  modified_base (538)..(538): a, c, t, g, unknown or other
  misc_feature (538)..(538): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaacgtggtccgccaggctccgaggggaagggcgtgggaggtgggtctctagttatttagtaggtcggtagtaaacacaatactacgactaagcctccgtagaaggggcagtacttcacctatctacccaagacgaactaatcccaaggaacacgctagtattacttacaaaatgaaacagcctagacgagtaccgaggaccaggactgtaatattactgtgacgagngaatcgtagtaacgttntttagactagtcggtacggacgaagg

SEQ ID NO: 308493 - DNA, 557 bp, Homo sapiens
  misc_feature: GZ8MTXP02JI485.9.12.B01.1.454.CMB.2.raw
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgtttatacggctccgacaacaagaactacttagcttggtatcagcagaaaccaggacagcctacctaaactgctcaattaacgtggcatcctacccggcaacgtcccggggtccctgaccgattcagtggcagcgggtctcgggacagtattcactctcaccatcagcagcctgcaggctagaagagtgtcggtactagtttacttactcgtactaacgttcggttttcgcggggtcgttacggaccgtaacgggaaccgaaggtacgaaatacgaaacgacgtagtcggactacgctacacgttctcgtcttactcttacctcccgtacacgtacgaactactactctacgg

SEQ ID NO: 308494 - DNA, 559 bp, Homo sapiens
  misc_feature: GZ8MTXP02FTHK0.9.12.B01.1.454.CMB.2.raw
  modified_base (381)..(381): a, c, t, g, unknown or other
  misc_feature (381)..(381): n is a, c, g, or t
  modified_base (507)..(507): a, c, t, g, unknown or other
  misc_feature (507)..(507): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagccgtgggggtccctgaaactctcctgtgcagcctctggatacaccgtcagtacgtaactccatgaactgggtccgccaggctccaggggaagggctggagtgggtctcagttattataggtcggtggtaacacatactacgacagactccgngtaaaggggcagacttcaacccatctaccagaagacaaattaccaggaaacacgctagtatacttacaaaatggaaacacgacctagaacgaggcgaacggacaggctagttatacttatgtacgngaagagtatgtgtaacgtcttttaggacttagtcgtcggggaccgtaaaggg

SEQ ID NO: 308495 - DNA, 643 bp, Homo sapiens
  misc_feature: GZ8MTXP02H3UOA.9.12.B01.1.454.CMB.2.raw
  modified_base (340)..(340): a, c, t, g, unknown or other
  misc_feature (340)..(340): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttcttgttgctattttaaaggtgtccagtgtgaggtgcagcgtggtggagtcgtgggggaggcgttggtccgaggccgtcggggggtccctaggaaactctcctgtgcacgcctctggatacacgtcagtagtaactccatgaacgtggtccgcacggctccgagggagggcgtggagtgggtntacgtagttattaagtagtcggtaggtaaccacagtacgtacgcagactccgtagaaggcagtatcactatccgcaggtacaactaacgtcccgaaggaaaaccctcgtacgttagttacttaacgtaacaaaagtacgaaacgtacgtaccgtaaggaacgtacggtaacggacgtaaccgtacggtacgttaagttaactaaacgtttacggtaggtggaacgtaaggtacgttaaccgtggttacgttacgttcgtttagtaacgttacggtaccgggtacgggaaaccgtaaaggaacg

SEQ ID NO: 308496 - DNA, 558 bp, Homo sapiens
  misc_feature: GZ8MTXP02JU9P2.9.12.B01.1.454.CMB.2.raw
  modified_base (527)..(527): a, c, t, g, unknown or other
  misc_feature (527)..(527): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaaactctcctgtgcagcctctggatacaccgtcagtagtaactccatgaactgggtccgccaggcgtccgaggggaaggggctgggaggtgggtctcgtagtttatttaatagcggtaggtaacccacgatactacgcagactccggtgaagggcagatcacatcctcagagacaattcccaaggacacgctgtatcttacaaatagaaccagcctagaagtagcgaaggacacggcttagtaactattaactggtgcgaagacggatcggtgtaaccgttntttagacttacgtcggacgggaacgaaggac

SEQ ID NO: 308497 - DNA, 559 bp, Homo sapiens
  misc_feature: GZ8MTXP02G4QSW.9.12.B01.1.454.CMB.2.raw
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttanacggctccgacaacaagaactacttagcttggtatcagcagaaaccaggacagcctacctaaactgctacattaacngggacactcctaccccggcaaccgtcccggggtccctagaccgtattccgagtggcaggccgggtcnggggacagtatttcactcctcnccatcagccngtacccgngacgagcaggaagagtggtgtacttagtttatacgtagtactacgttagtttcgcggtacgtacggacgagggaacgaaggtagaatacgaacgacgtgtagcacgacacgtctctcgtacttctactcctccgacctacgtacgtagtaacgtacgtactacg

SEQ ID NO: 308498 - DNA, 564 bp, Homo sapiens
  misc_feature: GZ8MTXP02FJ3FQ.9.12.B01.1.454.CMB.2.raw
  modified_base (304)..(304): a, c, t, g, unknown or other
  misc_feature (304)..(304): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (542)..(542): a, c, t, g, unknown or other
  misc_feature (542)..(542): n is a, c, g, or t
tcagtgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctatttaaaggtgtccagtgtgaggtgcagctggtggagtcgtgggggaggcgttggtccagccgtgggggtccctgaactctcctgtgcagcctctggatacaccgtcagtagtaactccatgaactgggtccncaggctccgagggaaggggcgtggagtgggtctcgtagttatttagtaggccggtagtaacacatactacgcacgactccggtaggaagggcaagacttcaaccattcccaccaagacgaactaactccaaaggaacncgactgtaactcttanaaatgaacacgctagagagtcgagacacggtactagtaatattactgtcgacgagagagttggtaacgttacgttcttttaggnttaacgtcggtacggggaaccg

SEQ ID NO: 308499 - DNA, 752 bp, Homo sapiens
  misc_feature: GZ8MTXP02IHLQT.9.12.B01.1.454.CMB.2.raw
  modified_base (264)..(264): a, c, t, g, unknown or other
  misc_feature (264)..(264): n is a, c, g, or t
  modified_base (576)..(576): a, c, t, g, unknown or other
  misc_feature (576)..(576): n is a, c, g, or t
  modified_base (667)..(667): a, c, t, g, unknown or other
  misc_feature (667)..(667): n is a, c, g, or t
tcagtgatacgtctcacgaccggtgctcgatttagtagtgtagattccgcggggagctctgggagaggagccccagcactgggattccgaggtgtttccattcagtgatctgcactgaacacagaggactcgccatggagtttgggctgagcttgggttttccttgttgcttattttaaaaggtgtccagtgtgaggtgcagctggtggagtcgtgggggaggcttggtccaggccgtgggggtccctagaactctcctgtgcncgcctctggactacaccgtcgagtagtaacctccagtagaaccgtcggggtaccccgccgacgggtccgtacccggaagggggaacggggcgtaggggaggttcggggtcttacgtaaggttttaagtttaagtaggtaccgggttacggtaaaacctactaaacgtaccgtaccgaccgaacggtccgtacccgggtagggaaacgggggtccaaggtaacttacccaaacctagttcccaacccgaagaaacgtaaccttaaaccgtacccgaaacggtaaaccacgttacttagtacttacccttaaanaaaacttcgggaaaacctaccggtaccgtaaggaacgacggttacggacgggaactaccggggtactttaagtaacgttaactttaccggnggttacggacgtaaaggtacgtaacttggtttaacgtcgtttacgttttagacttaaggtccggtaacgggggacgtaaaagggg

SEQ ID NO: 308500 - DNA, 552 bp, Homo sapiens
  misc_feature: GZ8MTXP02FGPIM.9.12.B01.1.454.CMB.2.raw
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtcgtgggggaggcttggtccagccgtggggggtccctgaactctcctgtgcagcctctggatacaccgtcagtagtaacnccatgaactgggtccnccaggctccgaggggaggggctggagtgggtctcaggtttatttagagtcggtaggtaaccacgtatactacgcagactccgngaaggcagatcaccntcncanagacaatccagacagctgatctanaaatgaacagcctagagacgtacgagggacacggctagtaataattacctggtcgacggaagacgtaagtcgtagtaaccgtgttttagatacgtcggtacgggggaccaaaggggtaacg

SEQ ID NO: 308501 - DNA, 629 bp, Homo sapiens
  misc_feature: GZ8MTXP02G4OAJ.9.12.B01.1.454.CMB.2.raw
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
  modified_base (471)..(471): a, c, t, g, unknown or other
  misc_feature (471)..(471): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagacctccctggctgtgtctctgggcgagacgggccaccatcaactgcaagtccagccagagttgtttanacggctccgaacaacaaagaactacttagcttggtatcagcaagaaaccaggacacgccctacctaaactgcctacaatttaaaccgngggaccactccgtaaccccccggactaaaccgtccccggggtaccctaggacccgtattccgagtcgggaccgagggccggggtcgtaggggaacagtactttccgactctacacctatccagcacgccctgacgnggactagaagagtggtacgtactaagttttacttcgtagtactaaacgttcgtttcgtacgggggtacgtttacggaccggtaaacgggaaccgtaaagggtacgtaaaacgtaaccgaaaaccggtaacgtaggtacggactacggaccctacgtac

SEQ ID NO: 308502 - DNA, 647 bp, Homo sapiens
  misc_feature: GZ8MTXP02FND3J.9.12.B01.1.454.CMB.2.raw
  modified_base (244)..(244): a, c, t, g, unknown or other
  misc_feature (244)..(244): n is a, c, g, or t
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
tcagtgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagattgtttanacggctccgacaacaagaactacttagcttaggtatcagcaagaaaccaggacagccctacctaaaactgactacgattaaacgtgggacacttcctaaccccccggactaaacgtcccgggggtacccctaggacccgtatttccgagttcgggcaggcgggttctaggggactaagtatttaccactactcaaccctaatccgaagccgaancccgtgaccgaagggacttaggaaaagtnttagggtccggtactaagttttaattacgttagttactaaaccgttagttttccgtcgggtcgtttacgggaccgtaaaacggggaacccgtaacggggtagggtaaaacttacgaaaaaccgaacgtttacggtaggaccgttggaccttaacctaacg

SEQ ID NO: 308503 - DNA, 560 bp, Homo sapiens
  misc_feature: GZ8MTXP02IU9K0.9.12.B01.1.454.CMB.2.raw
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
  modified_base (455)..(455): a, c, t, g, unknown or other
  misc_feature (455)..(455): n is a, c, g, or t
tcagtgatacgtctcacgaccggtgctcgatttagtagtgtagattccgcggggagctctgggagaggagcccagcactgggattccgaggtgtttccattcagtgatctgcactgaacacagaggactcgccatggagtttgggctgagctgggttttccttgttgctatttaaaaggtgtccagtgtgaggtgcagctggtggagtcgtgggggaggcgttggtccagccgtgggggtccctgaactctcctgtgcagcctctggatacaccgtnagtagtaactccatgaactgggtccgccaggcctcgaggggaaggggctggaggtgggtctctagtttatttanagtcggtaggtaacatatactacgacagcgtccgtagacgggcagacttacacattcacagaacgactaatccgaaggaacacgctgattactacaaatcgaanacgctagaagcgtacgagaccaggctagtaactattacgtaggtcaggagacgagttggtagtaacctgttttgaacttagtccggtagggggacctaaaagggg

SEQ ID NO: 308504 - DNA, 671 bp, Homo sapiens
  misc_feature: GZ8MTXP02JPU9A.9.12.B01.1.454.CMB.2.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
  modified_base (533)..(533): a, c, t, g, unknown or other
  misc_feature (533)..(533): n is a, c, g, or t
tcagtgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctgggtggagtcgtgggggaggtcgttggtccaggccggtggggggtccctagaactctcctgtgcagcctntggactacgaccgtcaagtacgtaacctccatacgaacgtcgggtcccnccgaggccgtaccggaggggaaggggcgtgggaggtgggtctacgtagtttattagtaggtacggtacggtaaaccactaacgtaactacggacaacgtaccgtccgggtaggaaacgggacgaagtacgttaccaacctatacctacccgaagaacgaactaacttaccgaaggtaaccacgtcttagtactcttaaacaaagtacggaaacncggtacctagggaacgaacggtaccggaacgggaccgtacgggtacttaggtaaatacgtttacgagtcggaacgaagtacggattaggttacgttacgtcgtttagacttaggtcgtacggggaccaacgggtaacg

SEQ ID NO: 308505 - DNA, 538 bp, Homo sapiens
  misc_feature: GZ8MTXP02IOGLY.9.12.B01.1.454.CMB.2.raw
  modified_base (290)..(290): a, c, t, g, unknown or other
  misc_feature (290)..(290): n is a, c, g, or t
  modified_base (413)..(413): a, c, t, g, unknown or other
  misc_feature (413)..(413): n is a, c, g, or t
tcagtgatacgtctcacgaccggtgctcgatttagtagtgtagattccgcgggcgtagactttgtgtttctcgtagtctgctttgctcagcgtcagggtgctgctgaggctgtaggtgctgtccttgctgtcctgctctgtgacactctcctgggagttacccgattggagagggccaccatcaactgcaagtccagccagagtgttttatacggctccgaacaacaagaactacttagcttggtatcagacagaaaccaggacagacctccaaactcgctacattaacnggcactcctacccgcaacgtccggggtccctgaccgattcgagtggacgaggcgggtctggggacagtatttcacttctcaccatcacgcagctagcagctagagagtgtgctagtttatctntactattagttcgaggtccgtcgacgtacgggaacgaggaagaatacgaaacgtagtagtagctagcactctacgcgttctacaccttccgtcccgactacgtcgtaacgacgtactacgtaccg
